(12) United States Patent
Hermans et al.

(10) Patent No.: US 8,907,065 B2
(45) Date of Patent: Dec. 9, 2014

(54) POLYPEPTIDES THAT MODULATE THE INTERACTION BETWEEN CELLS OF THE IMMUNE SYSTEM

(75) Inventors: Guy Hermans, Zwijnaarde (BE); Peter Verheesen, Ghent (BE); Edward Dolk, Utrecht (NL); Hendricus Renerus Jacobus Mattheus Hoogenboom, Maastricht (NL); Michael John Scott Saunders, Brussels (BE); Johannes Joseph Wilhelmus De Haard, Oudelande (NL); Renee de Bruin, Utrecht (NL)

(73) Assignee: Ablynx N.V., Zwijnaarde (BE)

( * ) Notice: Subject to any disclaimer, the term of this patent is extended or adjusted under 35 U.S.C. 154(b) by 1370 days.

(21) Appl. No.: 12/448,260

(22) PCT Filed: Dec. 17, 2007

(86) PCT No.: PCT/EP2007/011057
§ 371 (c)(1),
(2), (4) Date: Jun. 15, 2009

(87) PCT Pub. No.: WO2008/071447
PCT Pub. Date: Jun. 19, 2008

(65) Prior Publication Data
US 2010/0028341 A1    Feb. 4, 2010

Related U.S. Application Data

(60) Provisional application No. 60/875,246, filed on Dec. 15, 2006, provisional application No. 60/993,053, filed on Sep. 7, 2007.

(51) Int. Cl.
*C07K 16/28* (2006.01)
*A61K 39/395* (2006.01)

(52) U.S. Cl.
CPC ....... *C07K 16/2827* (2013.01); *C07K 2317/569* (2013.01); *C07K 2317/24* (2013.01); *C07K 2317/22* (2013.01); *C07K 2316/96* (2013.01); *C07K 16/2818* (2013.01)
USPC .................................. 530/387.1; 424/130.1

(58) Field of Classification Search
CPC ........... C07K 16/2818; C07K 2316/96; C07K 2317/22; C07K 2317/24; C07K 2317/569
See application file for complete search history.

(56) References Cited

U.S. PATENT DOCUMENTS 5,665,862 A * 9/1997 Fischbach et al. ............. 530/350
5,869,050 A * 2/1999 de Boer et al. ............. 424/156.1
6,632,927 B2 * 10/2003 Adair et al. ................. 530/387.3

OTHER PUBLICATIONS

Choi et al., J. Immunol., 2004, 172: 7399-7407.*
Kang et al., J. Immunol., 2005, 175: 685-692.*
Rao et al., International Immunopharmacology, 2003, 3: 435-443.*
Rudikoff et al. 1982, Proc. Natl. Acad. Sci. USA, 79: 1979-1983.*
Panka et al., 1988, Proc. Natl. Acad. Sci. USA, 85: 3080-3084.*
Sequence alignment, 2012, one page.*
Abrams et al., Blockade of T lymphocyte costimulation with cytotoxic T lymphocyte-associated antigen 4-immunoglobulin (CTLA4Ig) reverses the cellular pathology of psoriatic plaques, including the activation of keratinocytes, dendritic cells, and endothelial cells. J Exp Med. Sep. 4, 2000;192(5):681-93.
Adorini, New trends in clinical and experimental immunosuppression—fourth international conference. Feb. 17-20, 2000, Geneva, Switzerland. IDrugs. May 2000;3(5):496-8.
Alegre et al., T-cell regulation by CD28 and CTLA-4. Nat Rev Immunol. Dec. 2001;1(3):220-8.
Butte et al., Programmed death-1 ligand 1 interacts specifically with the B7-1 costimulatory molecule to inhibit T cell responses. Immunity. Jul. 2007;27(1):111-22. Epub Jul. 12, 2007.
Chambers et al., CTLA-4-mediated inhibition in regulation of T cell responses: mechanisms and manipulation in tumor immunotherapy. Annu Rev Immunol. 2001;19:565-94.
Collins et al., The interaction properties of costimulatory molecules revisited. Immunity. Aug. 2002;17(2):201-10.
Coyle et al., The expanding B7 superfamily: increasing complexity in costimulatory signals regulating T cell function. Nat Immunol. Mar. 2001;2(3):203-9.
Coyle et al., The role of ICOS and other costimulatory molecules in allergy and asthma. Springer Semin Immunopathol. Feb. 2004;25(3-4):349-59. Epub Jan. 14, 2004.
Dincq et al., Expression and purification of monospecific and bispecific recombinant antibody fragments derived from antibodies that block the CD80/CD86-CD28 costimulatory pathway. Protein Expr Purif. Jun. 2001;22(1):11-24.
Friedberg et al., Updated results from a phase II study of galiximab (anti-CD80) in combination with rituximab for relapsed or refractory, follicular NHL. Blood. 2005;106: 685a; abstract 2435.
Furukawa et al., Association of B7-1 co-stimulation with the development of graft arterial disease. Studies using mice lacking B7-1, B7-2, or B7-1/B7-2. Am J Pathol. Aug. 2000;157(2):473-84.
Gottlieb et al., Results of a single-dose, dose-escalating trial of an anti-B7.1 monoclonal antibody (IDEC-114) in patients with psoriasis. J Invest Dermatol 2000; 114: 840; abstract 546.
Howard et al., Therapeutic blockade of TCR signal transduction and co-stimulation in autoimmune disease. Curr Drug Targets Inflamm Allergy. Apr. 2005;4(2):85-94.
Hufton et al., Development and application of cytotoxic T lymphocyte-associated antigen 4 as a protein scaffold for the generation of novel binding ligands. FEBS Lett. Jun. 23, 2000;475(3):225-31.
Karandikar et al., Targeting the B7/CD28:CTLA-4 costimulatory system in CNS autoimmune disease. J Neuroimmunol. Aug. 14, 1998;89(1-2):10-18.
Keler et al., Activity and safety of CTLA-4 blockade combined with vaccines in cynomolgus macaques. J Immunol. Dec. 1, 2003;171(11):6251-9.

(Continued)

*Primary Examiner* — Ilia Ouspenski
(74) *Attorney, Agent, or Firm* — Wolf, Greenfield & Sacks, P.C.

(57) ABSTRACT

The present invention relates to amino acid sequences that block the interaction between (a target on) an antigen presenting cell (APC) and (a target on) a T-cell. More particularly, the present invention relates to amino acid sequences that are directed against (as defined herein) a target on an APC (also referred to herein as "APC target") or a target on a T-cell (also referred to herein as "T-cell target"). The invention further relates to compounds or constructs, and in particular proteins and polypeptides, that comprise or essentially consist of one or more such amino acid sequences.

34 Claims, 42 Drawing Sheets

(56) References Cited

OTHER PUBLICATIONS

Figure 1:
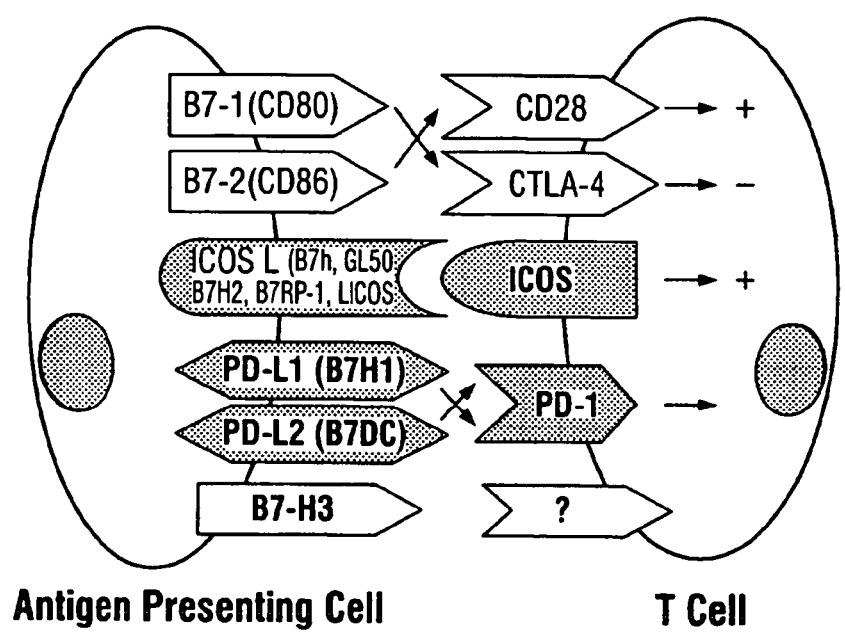

Kopf et al., Inducible costimulator protein (ICOS) controls T helper cell subset polarization after virus and parasite infection. J Exp Med. Jul. 3, 2000;192(1):53-61.

Larsen et al., Rational development of LEA29Y (belatacept), a high-affinity variant of CTLA4-Ig with potent immunosuppressive properties. Am J Transplant. Mar. 2005;5(3):443-53.

Oosterwegel et al., CTLA-4 and T cell activation. Curr Opin Immunol. Jun. 1999;11(3):294-300.

Ozkaynak et al., Importance of ICOS-B7RP-1 costimulation in acute and chronic allograft rejection. Nat Immunol. Jul. 2001;2(7):591-6.

Podojil et al., CD4+ T cell expressed CD80 regulates central nervous system effector function and survival during experimental autoimmune encephalomyelitis. J Immunol. Sep. 1, 2006;177(5):2948-58.

Podojil et al., CD86 and beta2-adrenergic receptor stimulation regulate B-cell activity cooperatively. Trends Immunol. Apr. 2005;26(4):180-5.

Rottman et al., The costimulatory molecule ICOS plays an important role in the immunopathogenesis of EAE. Nat Immunol. Jul. 2001;2(7):605-11.

Salama et al., Challenges to achieving clinical transplantation tolerance. J Clin Invest. Oct. 2001;108(7):943-8.

Stuart et al., Targeting T cell costimulation in autoimmune disease. Expert Opin Ther Targets. Jun. 2002;6(3):275-89.

Van Den Beucken et al., Building novel binding ligands to B7.1 and B7.2 based on human antibody single variable light chain domains. J Mol Biol. Jul. 13, 2001;310(3):591-601.

Waldmann, Effective cancer therapy through immunomodulation. Annu Rev Med. 2006;57:65-81.

Webb et al., Prevention and amelioration of collagen-induced arthritis by blockade of the CD28 co-stimulatory pathway: requirement for both B7-1 and B7-2. Eur J Immunol. Oct. 1996;26(10):2320-8.

Yamada et al., The role of novel T cell costimulatory pathways in autoimmunity and transplantation. J Am Soc Nephrol. Feb. 2002;13(2):559-75.

Zhang et al., Crystal structure of the receptor-binding domain of human B7-2: insights into organization and signaling. Proc Natl Acad Sci U S A. Mar. 4, 2003;100(5):2586-91. Epub Feb. 26, 2003.

\* cited by examiner

Fig. 39

```
           1          10         20         30         40         50         60      SEQ ID NO
           |----------|----------|----------|----------|----------|----------|
4CTLA11F1  EVQLVESGGGLVQAGGSLRLSCAASGGTFSFYGMGMFRQAPGKEQEFVADIRTSAGRTYY          1306
VH3-23     EVQL+ESGGGLVQ GGSLRLSCAASG TFS Y M W RQAPGK E+V+ I  S  G  TYY
VH3-48     EVQLLESGGGLVQPGGSLRLSCAASGFTFSSYAMSWVRQAPGKGLEWVSAISGSGGSTYY          1400
VH3-7      EVQLVESGGGLVQPGGSLRLSCAASGFTFSSYSMNWVRQAPGKGLEWVSYISSSSSTIYY          1401
                                                                               1402
           EVQLVESGGGLVQPGGSLRLSCAASGFTFSSYWMSWVRQAPGKGLEWVANIKQDGSEKYY 61         70         80         90        100        110
           |----------|----------|----------|----------|----------|
           |---a------|          |---abc----|          |--ab--|
4CTLA11F1  ADSVKGRFTISRDNAKNTLVYLQMNSLKPEEDTAVYYCAAemsqisqwdvWGQGTQVTVSS
VH3-23     ADSVKGRFTISRDN+KNT+YLQMNSL+  EDTAVYYCA
VH3-48     ADSVKGRFTISRDNSKNTLYLQMNSLRAEDTAVYYCAK          WGQGTLVTVSS
VH3-7      ADSVKGRFTISRDNAKNSLYLQMNSLRDEDTAVYYCAR          WGQGTLVTVSS
           VDSVKGRFTISRDNAKNSLYLQMNSLRAEDTAVYYCAR          WGQGTLVTVSS
```

Fig. 40

```
                   1            10              20              30              40              50              60
                   |------------|---------------|---------------|---------------|---------------|---------------|
4CTLA11E3          EVQLVESGGGLVEPGGSLRLSCAASGSISSYNVMGWVRQAPGQQRDLVAHIASNGE-IMY

VH3-53             EVQLVESGGGL++PGGSLRLSCAASG     S N M W RQAPG+   + V+ I S G - Y
VH3-66             EVQLVESGGGLIQPGGSLRLSCAASGFTVSSNYMSWVRQAPGKGLEWVSVIYSGGS-TYY
VH3-11             QVQLVESGGGLVKPGGSLRLSCAASGFTFSDYMSWIRQAPGKGLEWVSYISSSGSTIYY 61              70              80              90              100             110
                   |---------------|---------------|---------------|---------------|---------------|
                   |---a---|                |---abc---|
4CTLA11E3          ADSAKGRFTISRDNAKTMVLQMNSLKPEDTAVYYCKLwvlqndyWGQGTQVTVSS VH3-53             ADS KGRFTISRDN+K  T+YLQMNSL+  EDTAVYYC
VH3-66             ADSVKGRFTISRDNSKNTLYLQMNSLRAEDTAVYYCAR          WGQGTLVTVSS
VH3-11             ADSVKGRFTISRDNSKNTLYLQMNSLRAEDTAVYYCAR          WGQGTLVTVSS
                   ADSVKGRFTISRDNAKNSLYLQMNSLRAEDTAVYYCAR          WGQGTLVTVSS
```

|            | SEQ ID NO |
|------------|-----------|
|            | 1296      |
|            | 1403      |
|            | 1404      |
|            | 1405      |

Fig. 41

```
                 1            10            20            30            40            50            60
                 |----:----|----:----|----:----|----:----|----:----|----:----|
4CTLA11F1        EVQLVESGGGLVQAGGSLRLSCAASGGTFSFYGMGWFRQAPGKEQEFVADIRTSAGRTYY
11F1basic        EVQLVESGGGLVQPGGSLRLSCAASGFTFSFYGMGWFRQAPGKQEFVADIRTSAGRTYY
11F1hum1         EVQLVESGGGLVQPGGSLRLSCAASGFTFSFYGMGWFRQAPGKQEFVADIRTSAGRTYY
11F1hum2         EVQLVESGGGLVQPGGSLRLSCAASGGTFSFYGMGWFRQAPGKQEFVADIRTSAGRTYY
11F1hum3         EVQLVESGGGLVQPGGSLRLSCAASGGTFSFYGMGWFRQAPGKQEFVADIRTSAGRTYY
11F1hum4         EVQLVESGGGLVQPGGSLRLSCAASGGTFSFYGMGWFRQAPGKQEFVSDIRTSAGRTYY
11F1hum5         EVQLVESGGGLVQPGGSLRLSCAASGGTFSFYGMGWFRQAPGKQEFVADIRTSAGRTYY 61           70            80            90           100           110
                 |----a----|----abc---|----:----|---ab----|----:----|
                 |----:----|----:----|----:----|----:----|----:----|
4CTLA11F1        ADSVKGRFTISRDNAKNTVYLQMNSLRPEDTAVYYCAAEmsgisqwdyWGQGTQVTVSS       1296
11F1basic        ADSVKGRFTISRDNAKNTLYLQMNSLRPEDTAVYYCAAemsgisgwdyWGQGTLVTVSS      1407
11F1hum1         ADSVKGRFTISRDNAKNTLYLQMNSLRPEDTAVYYCAAemsgisgwdyWGQGTLVTVSS      1408
11F1hum2         ADSVKGRFTISRDNSKNTLYLQMNSLRPEDTAVYYCAAemsgisgwdyWGQGTLVTVSS      1409
11F1hum3         ADSVKGRFTISRDNAKNSLYLQMNSLRPEDTAVYYCAAemsgisgwdyWGQGTLVTVSS      1410
11F1hum4         ADSVKGRFTISRDNAKNTLYLQMNSLRPEDTAVYYCAAemsgisgwdyWGQGTLVTVSS      1411
11F1hum5         AESVKGRFTISRDNAKNTLYLQMNSLRPEDTAVYYCAAemsgisgwdyWGQGTLVTVSS      1412
```

SEQ ID NO

Fig. 42

```
                 1           10           20          30           40          50          60
                 |-----------|------------|-----------|------------|-----------|-----------|
4CTLA11E3        EVQLVESGGGLVEPGGSLRLSCAASGSISSYNVMGWYRQAPGQQRDLVAHIASNGEIMY
11E3basic        EVQLVESGGGLIQPGGSLRLSCAASGSISSYNVMGWYRQAPGQQRDLVAHIASNGEIMY
11E3hum1         EVQLVESGGGLIQPGGSLRLSCAASGFTVSYNVMGWYRQAPGQQRDLVAHIASNGEIMY
11E3hum2         EVQLVESGGGLIQPGGSLRLSCAASGSISSYNVMGWYRQAPGQQRDLVAHIASNGEIMY
11E3hum3         EVQLVESGGGLIQPGGSLRLSCAASGSISSYNVMGWYRQAPGKGRDLVAHIASNGEIMY
11E3hum4         EVQLVESGGGLIQPGGSLRLSCAASGSISSYNVMGWYRQAPGQQRDLVAHIASNGEIMY
11E3hum5         EVQLVESGGGLIQPGGSLRLSCAASGSISSYNVMGWYRQAPGQQRDLVSHIASNGEIMY 61           70          80           90          100          110          SEQ ID NO
                 |-----------|------------|-----------|------------|-----------|-----------|
                     ---a----                 --abc---                      ----
4CTLA11E3        ADSVKGRFTISRDNAKTTVYLQMNSLKPEDTAVYYCKLwvlqndyWGQGTQVTVSS     1296
11E3basic        ADSVKGRFTISRDNAKKTLYLQMNSLRPEDTAVYYCKLwvlgndyWGQGTLVTVSS     1413
11E3hum1         ADSVKGRFTISRDNAKKTLYLQMNSLRPEDTAVYYCKLwvlgndyWGQGTLVTVSS     1414
11E3hum2         ADSVKGRFTISRDNAKKTLYLQMNSLRPEDTAVYYCKLwvlgndyWGQGTLVTVSS     1415
11E3hum3         ADSVKGRFTISRDNAKKTLYLQMNSLRPEDTAVYYCKLwvlgndyWGQGTLVTVSS     1416
11E3hum4         ADSVKGRFTISRDNAKKTLYLQMNSLRPEDTAVYYCKLwvlgndyWGQGTLVTVSS     1417
11E3hum5         ADSVKGRFTISRDNAKNTLYLQMNSLRPEDTAVYYCKLwvlgndyWGQGTLVTVSS     1418
```

POLYPEPTIDES THAT MODULATE THE INTERACTION BETWEEN CELLS OF THE IMMUNE SYSTEM

RELATED APPLICATIONS

This application is a national stage filing under 35 U.S.C. §371 of international application PCT/EP2007/011057, filed Dec. 17, 2007, which was published under PCT Article 21(2) in English, and claims the benefit under 35 U.S.C. §119(e) of U.S. provisional application Ser. No. 60/875,246, filed Dec. 15, 2006 and of U.S. provisional application Ser. No. 60/993,053, filed Sep. 7, 2007, the disclosures of which are incorporated by reference herein in their entireties.

The present invention relates to amino acid sequences that block the interaction between (a target on) an antigen presenting cell (APC) and (a target on) a T-cell. More particularly, the present invention relates to amino acid sequences that are directed against (as defined herein) a target on an APC (also referred to herein as "APC target") or a target on a T-cell (also referred to herein as "T-cell target"), in particular, against targets that belong to the B7:CD28 superfamily (such as B7-1, B7-2, B7RP-1, PD-L1, PD-L2, B7H-3 and B7x ["APC targets"] and their receptors CD28, CTLA-4, ICOS, PD-1, BTLA and TIM-3 ["T-cell targets"]). The invention further relates to compounds or constructs, and in particular proteins and polypeptides, that comprise or essentially consist of one or more such amino acid sequences (also referred to herein as "amino acid sequences of the invention", "compounds of the invention", and "polypeptides of the invention", respectively).

The invention also relates to nucleic acids encoding such amino acid sequences and polypeptides (also referred to herein as "nucleic acids of the invention" or "nucleotide sequences of the invention"); to methods for preparing such amino acid sequences and polypeptides; to host cells expressing or capable of expressing such amino acid sequences or polypeptides; to compositions, and in particular to pharmaceutical compositions, that comprise such amino acid sequences, polypeptides, nucleic acids and/or host cells; and to uses of such amino acid sequences or polypeptides, nucleic acids, host cells and/or compositions, in particular for prophylactic, therapeutic or diagnostic purposes, such as the prophylactic, therapeutic or diagnostic purposes mentioned herein.

Other aspects, embodiments, advantages and applications of the invention will become clear from the further description herein.

Costimulatory molecules are expressed on the membrane of activated antigen presenting cells (APC) such as dendritic cells, macrophages or B-cells. The presence of costimulatory molecules on the APC is required ("signal 2") alongside antigenic peptide in the context of the MHC molecule ("signal 1") to obtain efficient stimulation of naïve antigen reactive T-cells. The presence of costimulatory molecules is sensed by receptors on the surface of the T-cell. Selective blockade of the interaction of such costimulatory molecules with their cognate activating receptor (such as CD28) on the T-cell may therefore inhibit T-cell activation (Howard et al., Current Drug Targets—Inflammation & Allergy 4: 85, 2005; Stuart and Racke, Expert Opin. Ther. Targets 6: 275-89, 2002).

B7-1 (CD80) and B7-2 (CD86) are by far the best studied costimulatory molecules and are members of the B7:CD28 superfamily. The B7:CD28/CTLA-4 pathway has a pivotal role in regulating T-cell activation and tolerance. The B7-1 (CD80) and B7-2 (CD86) costimulatory molecules provide a major signal for augmenting and sustaining T-cell responses through interaction with CD28, but deliver inhibitory signals when they engage a second, higher affinity receptor on T cells, cytotoxic T lymphocyte-associated antigen 4 (CTLA-4 or CD152) (Alegre et al. Nat. Immunol. Rev. 1:220, 2001).

CTLA4 or CD152 is another receptor on T-cells for both CD80 and CD86. Unlike CD28, however, interaction of CD152 with CD80 and/or CD86 does not lead to T-cell activation. CD152 is thought to interact with both CD80 and CD86 with a higher affinity than CD28, and may therefore serve as a decoy receptor for CD28, depriving the latter of its ligands and therefore indirectly decreasing T-cell activation (Collins et al., Immunity 17: 201, 2002). Alternatively, CD152 may also transduce a negative signal into the T-cell, leading to lower overall levels of T-cell activation. Regardless of the mechanism, the activity of CD152 signaling leads to a dampening of T-cell responses, especially late (48-72H) after T-cell stimulation when surface CD152 expression becomes high (Oosterwegel et al. Curr. Opin. Immunol. 11: 294, 1999.

The B7-1/B7-2:CD28/CTLA-4 pathway is the best characterized T-cell costimulatory pathway and has a critical role in regulating T cell activation and tolerance. Additional B7 and CD28 family members, however, have been identified (FIG. 1), and two new pathways have been delineated: (a) one pathway involving inducible co-stimulator (ICOS) that interacts with a ligand that we call ICOS ligand (but is also known as B7h, GL50, B7RP-1, LICO, and B7-H2) and (b) a second pathway involving the PD-1 receptor that interacts with two new B7 family members, PD-L1 and PD-L2. In addition, there is another B7 homolog, B7-H3 (whose receptor remains to be identified), which suggests that there are still additional pathways within the B7:CD28 superfamily to be identified.

Studies of ICOS pathway blockade suggest that this pathway may be an attractive target for blocking chronic inflammation. Because ICOS co-stimulation is important for IL-10 production, ICOS may be important for T-cell tolerance, when IL-10-producing T regulatory cells have a role in T-cell tolerance. Because CD28 and ICOS have both synergistic and overlapping effects, combination therapy may be advantageous, particularly for inhibiting established immune responses.

The phenotype of PD-1$^{-/-}$ mice implicates PD-1 in down-regulating immune responses and regulating tolerance of peripheral T or B cells or both. PD-L1 and PD-L2 expression in nonlymphoid tissues suggests that this pathway regulates inflammatory responses in peripheral tissues. Further studies are needed to elucidate PD-L1 and PD-L2 functions.

Because the B7:CD28 superfamily pathways deliver signals necessary for T-cell activation, there has been great interest in manipulating this pathway for therapy. Blockade could inhibit undesired T-cell responses occurring during autoimmunity, transplant rejection, or allergy, whereas stimulation through this pathway could promote T-cell responses for tumor and vaccine immunity.

Activated self-antigen directed T-cells are responsible for at least part of the tissue damage in autoimmune diseases such as rheumatoid arthritis or multiple sclerosis by virtue of their effector function, and indirectly for production of high-affinity self-reactive antibodies by providing "help" to B-cells. Thus, blockade of the interaction of CD80 and/or CD86 with CD28 can be therapeutic in autoimmune conditions. These principles have been firmly established in both animal models of human disease, as well as in man, by using either blocking monoclonal antibodies directed against CD80 or CD86, or using soluble forms of their receptor (Stuart and Racke, 2002). CTLA-4 immunoglobulin (CTLA4-Ig), a soluble form of CTLA4, which blocks the interactions of B7-1 and B7-2 with both CD28 and CTLA-4, has entered clinical trials for rheumatoid arthritis (abatacept; Webb et al. European Journal of Immunology 26: 2320-2328, 1996), multiple sclerosis (Adorini, New Trends in Clinical and Experimental Immunosuppression—Fourth International Conference, Geneva, Switzerland, 17-20 Feb. 2000), and systemic lupus erythematosus (SLE) (Website pipeline RepliGen, 2006, Jan. 9). A primatized anti-B7-1 antibody (IDEC-114), genetically engineered from cynomolgus macaque monkey and human components, is being developed as a novel treatment for autoimmune and inflammatory diseases such as psoriasis and rheumatoid arthritis, and is currently undergoing phase I/II trials in patients with psoriasis (Gottlieb et al. J. Investigative Dermatology 114: 840, 2000).

ICOS blockade during the effector phase of EAE, an animal model for multiple sclerosis (MS), can inhibit disease progression and ameliorate EAE (Rottman et al., Nat. Immunol. 2: 605-611, 2001), which suggests that ICOS co-stimulation has a key role in sustaining effector Th1 cells. When B7:CD28 interactions are blocked during the effector phase, EAE is transient and mild. Thus, B7:CD28 interactions are also critical for sustaining effector T cells. However, the effects of CD28 signaling are mainly on T-cell expansion, whereas ICOS mainly affects effector cytokine production.

Pathway antagonists have also been shown to enable long-term graft survival and suppress autoimmunity (Salama et al., J. Clin. Invest. 108: 943, 2001). A mutant form of CTLA4-Ig (betalacept), for example, is also being developed for the prevention of acute rejection and maintenance therapy of kidney transplants (Larsen et al., Am. J. Transplantation 5: 443, 2005). In a Th1-mediated cardiac allograft rejection model, blockade or elimination of ICOS co-stimulation prolongs acute cardiac allograft survival and suppresses intragraft cytokine production, particularly IFN-g and IL-10 (Ozkaynak E, et al., Nat. Immunol. 2: 591-596, 2001). ICOS blockade also prevents transplant arteriosclerosis that develops when the CD40:CD40L pathway is blocked (Ozkaynak et al., Nat. Immunol. 2: 591-596, 2001). B7:CD28 blockade similarly prevents graft arteriosclerosis (Furukawa et al., Am. J. Pathol. 157: 473-484, 2000). Thus, ICOS and CD28 similarly promote inflammation underlying graft arteriopathy.

Blocking CD152 signaling by the use of monoclonal antibodies blocking its interaction with CD80 and/or CD86 increases the level of T-cell activation in vivo, and this has been demonstrated to be beneficial as an adjunct treatment in tumor vaccine therapies. A fully human monoclonal antibody against CTLA4 (Keler et al., J. Immunol. 171: 6251, 2003; Longber, Human antibodies 12: 1, 2003) has entered phase III clinical trials in patients with metastatic melanoma. Since inhibition of CTLA4 signaling leads to very different outcomes than CD28 blockade during T-cell activation, it may be beneficial to design a CD80 and/or CD86 neutralizing therapeutic entity which inhibits the interaction of CD80 and/or CD86 with CD28 but not CTLA4, or vice versa.

CD80 and CD86 are also present at high levels on many lymphomas of B-cell origin. Thus, monoclonal antibodies, fragments thereof and other proteins binding CD80 and/or CD86 can be useful in the therapy of such tumors, either by recruiting effector functions, induction of cell death or as a targeting entity in immunotoxin- or radiotoxin conjugates (Friedberg et al., Blood 106: 11, Abs 2435, 2005).

Results of studies in murine models of virus and parasite infections have suggested synergies between ICOS and CD28. ICOS blockade in CD28$^{-/-}$ mice further reduced Th1/Th2 polarization in viral and parasitic infection models (Kopf et al., J. Exp. Med. 192: 53-61, 2000). ICOS-Ig abrogated IFN-g production by virus-specific T cells from LCMV-infected CD28$^{-/-}$ mice. ICOS can regulate both CD28-dependent and CD28-independent CD4$^+$ subset responses. CTLA-4 can oppose T-cell activation by either CD28 or ICOS. A phase I/II clinical trial has been initiated for HIV infection with a fully human monoclonal antibody against CTLA4 (Keler et al., J. Immunol. 171: 6251, 2003; Longber, Human antibodies 12: 1, 2003).

Although CD80 and CD86 have at least partially redundant roles, it is clear that blockade of one or the other can have differential effects. For example, in experimental autoimmune encephalomyelitis (EAE), it has been demonstrated that blockade of CD80 by monoclonal antibodies can have beneficial effects on disease progression whereas treatments by CD86 blockade does not have a strong beneficial effect in this model. Importantly, the beneficial effect of CD80 blockade by monoclonal antibody is highly dependent on the time of treatment versus disease induction. Recently, it was also demonstrated that treatment with a monovalent (Fab) form of a blocking anti-CD80 monoclonal antibody dramatically improves disease in EAE, and treatment efficacy is not dependent on the time of treatment initiation (Podojil et al., J. Immunol. 177: 2948, 2006). This indicates that a strict monomeric CD80 blocking entity such as a Nanobody® or dAb might be advantageous over a bivalent anti-CD80 monoclonal antibody, illustrating that there is a need for alternative or improved amino acid sequences that can be used for modulating the interaction between cells of the immune system.

The present invention solves this problem by providing amino acid sequences, polypeptides and compositions that can generally be used to modulate, and in particular inhibit and/or prevent, binding of an APC target to a T-cell target (or vice-versa), and thus to modulate, and in particular inhibit or prevent, the signalling that is mediated by said APC target and/or said T-cell target, to modulate the biological pathways in which said APC target and/or said T-cell targets is involved, and/or to modulate the biological mechanisms, responses and effects associated with such signalling or these pathways.

In one aspect, the amino acid sequence, polypeptide or composition of the invention may increase T-cell survival. Without being limiting, in this aspect of the invention, T-cell survival is preferably increased to more than 50% T-cell survival, such as 50-100% T-cell survival, more preferably 70-100% T-cell survival, even more preferably 80-100% T-cell survival, such as 90-100% T-cell survival.

In another aspect, the amino acid sequence, polypeptide or composition of the invention may decrease T-cell survival. Without being limiting, in this aspect of the invention, T-cell survival is preferably decreased to less than 50% T-cell survival, such as 0-50% T-cell survival, more preferably 0-30% T-cell survival, even more preferably 20-50% T-cell survival, such as 0-10% T-cell survival. In yet another aspect, the amino acid sequence, polypeptide or composition of the invention may increase differentiation of naive T-cells into activated cytokine secreting T-cells. Without being limiting, in this aspect of the invention, differentiation is preferably increased by more than 50% of the naive T-cells, such as 50-100% of the naive T-cells, more preferably 70-100% of the naive T-cells, even more preferably 80-100% of the naive T-cells, such as 90-100% of the naive T-cells. In yet another aspect, the amino acid sequence, polypeptide or composition of the invention may decrease differentiation of naive T-cells into activated cytokine secreting T-cells. Without being limiting, in this aspect of the invention, differentiation is preferably decreased to less than 50% of the naive T-cells, such as 0-50% of the naive T-cells, more preferably 0-30% of the naive T-cells, even more preferably 0-20% of the naive T-cells, such as 0-10% of the naive T-cells.

As such, the polypeptides and compositions of the present invention can be used for the prevention and treatment (as defined herein) of autoimmune diseases, allergy and asthma, transplant rejections (acute and chronic), cancer and tumors, effector cell exhaustion, and/or infections. Generally, "autoimmune diseases, allergy and asthma, transplant rejections (acute and chronic), cancer and tumors, effector cell exhaustion and infections" can be defined as diseases and disorders that can be prevented and/or treated, respectively, by suitably administering to a subject in need thereof (i.e. having the disease or disorder or at least one symptom thereof and/or at risk of attracting or developing the disease or disorder) of either a polypeptide or composition of the invention (and in particular, of a pharmaceutically active amount thereof) and/or of a known active principle active against an APC target or a T-cell target or a biological pathway or mechanism in which an APC target or a T-cell target are involved (and in particular, of a pharmaceutically active amount thereof). Examples of such autoimmune diseases, allergies and asthma, transplant rejections (acute and chronic), cancer and tumors, effector cell exhaustion, and infections will be clear to the skilled person based on the disclosure herein, and for example include the following diseases and disorders: autoimmune diseases (Coyle and Gutierrez-Ramos, Nat. Immunol. 2: 203-209, 2001; Yamada et al., J. Am. Soc. Nephrol. 13: 559, 2002) such as human anti-glomerular basement membrane (GBM) disease (Reynolds et al., J. Clin. Invest. 105: 643-51, 2000), lupus nephritis (Liang et al., J. Immunol. 165: 3436-43, 2000), diabetes (Lenschow et al., J. Exp. Med. 181: 1145-55, 1995), collagen-induced arthritis (Knoerzer et al., J. Clin. Invest. 96: 987-93, 1995; Yamada et al., J. Am. Soc. Nephrol. 13: 559, 2002), autoimmune thyroiditis (Yamada et al., J. Am. Soc. Nephrol. 13: 559, 2002), autoimmune uveitis (Yamada et al., J. Am. Soc. Nephrol. 13: 559, 2002), psoriasis vulgaris (Abrams et al., J. Clin. Invest. 103: 1243-52, 1999; Abrams et al., J. Exp. Med. 192: 681-94, 2000), rheumatoid arthritis (Yamada et al., J. Am. Soc. Nephrol. 13: 559, 2002), CNS autoimmune diseases (Karandikar et al., Review J. Neuroimmunol. 89: 10, 1998), multiple sclerosis (Kuchroo et al., Cell 80: 707-18, 1995; Girvin et al., J. Immunol. 164: 136-43, 2000; Rottman et al., Nat. Immunol. 2: 605-611, 2001; Sporici and Perrin, Review, Clin. Immunol. 100: 263-9, 2001; Yamada et al., J. Am. Soc. Nephrol. 13: 559, 2002), Graves disease (Yamada et al., J. Am. Soc. Nephrol. 13: 559, 2002), Myasthenia gravis (MG) (Yamada et al., J. Am. Soc. Nephrol. 13: 559, 2002), Systemic lupus erythematosus (SLE) (Yamada et al., J. Am. Soc. Nephrol. 13: 559, 2002), Immune thrombocytopenic purpura (ITP) (Yamada et al., J. Am. Soc. Nephrol. 13: 559, 2002) and Psoriasis (Yamada et al., J. Am. Soc. Nephrol. 13: 559, 2002), Crohns disease (Liu et al., Scand. J. Gastroenterol. 32: 1241, 1997), Inflammatory Bowel Disease (IBD) and Ulcerative Colitus (US) (Polese et al. Acta Biomed. 74, Suppl. 2: 65, 2003; Scarpa et al. Dig. Dis. Sci. 49: 1738, 2004), Relapsing Experimental Autoimmune Encephalomyelitis (R-EAE) (Podojil et al. J. Immunol. 177: 2948, 2006); allergy and asthma (Yoshinaga et al., Nature 402: 827-32, 1999; Coyle and Gutierrez-Ramos, Nat. Immunol. 2: 203-209, 2001; Coyle and Gutierrez-Ramos, Springer Semin. Immunopathol. 25: 349-59, 2004) such as allergic contact dermatitis (Sayegh et al., J. Exp. Med. 181: 1869-74, 1995) and airway hyperresponsiveness (bronchial asthma, allergic lung inflammatory responses; Tsuyuki et al., J. Exp. Med. 185: 1671, 1998; Mathur et al., Am. J. Respir. Cell Mol. Biol. 21: 498-509, 1999; Gonzalo et al., Nat. Immunol. 2: 597-604, 2001); transplant rejections (acute and chronic; Ozkaynak et al., Nat. Immunol. 2: 591-6, 2001; Coyle and Gutierrez-Ramos, Nat. Immunol. 2: 203-209, 2001; Salama et al., J. Clin. Invest. 108: 943, 2001) such as renal transplant rejection (Sayegh and Turka, N. Engl. J. Med. 338: 1813-21, 1998; Sayegh, J. Clin. Invest. 103: 1223-5, 1999), bone marrow allograft rejection (Guinan et al., N. Engl. J. Med. 340: 1704-14, 1999, Comment in: N. Engl. J. Med. 340: 1754-6, 1999, N. Engl. J. Med. 341: 1081-2, 1999, N. Engl. J. Med. 341: 1082, 1999) and cardiac allograft rejection (Lin et al., J. Exp. Med. 178: 1801-6, 1993; Furukawa et al., Am, J, Pathol. 157: 473-484, 2000); cancer and tumors (Leach et al., Science. 271: 1734-6, 1996, Comment in: Science 271: 1691, 1996; Chambers et al., Review, Annu. Rev. Immunol. 19: 565-94, 2001; Coyle and Gutierrez-Ramos, Nat. Immunol. 2: 203-209, 2001); and viral infections (Kopf et al., J. Exp. Med. 192: 111, 2000).

Thus, without being limited thereto, the amino acid sequences and polypeptides of the invention can for example be used to prevent and/or to treat all diseases and disorders that are currently being prevented or treated with active principles that can modulate an APC target- or a T-cell target-mediated signalling, such as those mentioned in the prior art cited above. It is also envisaged that the polypeptides of the invention can be used to prevent and/or to treat all diseases and disorders for which treatment with such active principles is currently being developed, has been proposed, or will be proposed or developed in future. In addition, it is envisaged that, because of their favourable properties as further described herein, the polypeptides of the present invention may be used for the prevention and treatment of other diseases and disorders than those for which these known active principles are being used or will be proposed or developed; and/or that the polypeptides of the present invention may provide new methods and regimens for treating the diseases and disorders described herein.

Other applications and uses of the amino acid sequences and polypeptides of the invention will become clear to the skilled person from the further disclosure herein.

Generally, it is an object of the invention to provide pharmacologically active agents, as well as compositions comprising the same, that can be used in the diagnosis, prevention and/or treatment of autoimmune diseases, allergy and asthma, transplant rejections (acute and chronic), cancer and tumors, effector cell exhaustion, and infections, and of the further diseases and disorders mentioned herein; and to provide methods for the diagnosis, prevention and/or treatment of such diseases and disorders that involve the administration and/or use of such agents and compositions.

In particular, it is an object of the invention to provide such pharmacologically active agents, compositions and/or methods that have certain advantages compared to the agents, compositions and/or methods that are currently used and/or known in the art. These advantages will become clear from the further description below.

More in particular, it is an object of the invention to provide therapeutic proteins that can be used as pharmacologically active agents, as well as compositions comprising the same, for the diagnosis, prevention and/or treatment of autoimmune diseases, allergy and asthma, transplant rejections (acute and chronic), cancer and tumors, effector cell exhaustion, and infections and of the further diseases and disorders mentioned herein; and to provide methods for the diagnosis, prevention and/or treatment of such diseases and disorders that involve the administration and/or the use of such therapeutic proteins and compositions.

Accordingly, it is a specific object of the present invention to provide amino acid sequences that are directed against (as defined herein) an APC target or a T-cell target, in particular against an APC target or a T-cell target from a warm-blooded animal, more in particular against an APC target or a T-cell target from a mammal, and especially against a human APC target or T-cell target; and to provide proteins and polypeptides comprising or essentially consisting of at least one such amino acid sequence.

In particular, it is a specific object of the present invention to provide such amino acid sequences and such proteins and/or polypeptides that are suitable for prophylactic, therapeutic and/or diagnostic use in a warm-blooded animal, and in particular in a mammal, and more in particular in a human being.

More in particular, it is a specific object of the present invention to provide such amino acid sequences and such proteins and/or polypeptides that can be used for the prevention, treatment, alleviation and/or diagnosis of one or more diseases, disorders or conditions associated with an APC target and/or a T-cell target and/or mediated by an APC target and/or a T-cell target (such as the diseases, disorders and conditions mentioned herein) in a warm-blooded animal, in particular in a mammal, and more in particular in a human being.

It is also a specific object of the invention to provide such amino acid sequences and such proteins and/or polypeptides that can be used in the preparation of pharmaceutical or veterinary compositions for the prevention and/or treatment of one or more diseases, disorders or conditions associated with and/or mediated by an APC target and/or a T-cell target (such as the diseases, disorders and conditions mentioned herein) in a warm-blooded animal, in particular in a mammal, and more in particular in a human being.

In the invention, generally, these objects are achieved by the use of the amino acid sequences, proteins, polypeptides and compositions that are described herein.

In general, the invention provides amino acid sequences that are directed against (as defined herein) and/or can specifically bind (as defined herein) to an APC target or a T-cell target; as well as compounds and constructs, and in particular proteins and polypeptides, that comprise at least one such amino acid sequence.

More in particular, the invention provides amino acid sequences that can bind to an APC target or a T-cell target with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein; as well as compounds and constructs, and in particular proteins and polypeptides, that comprise at least one such amino acid sequence.

In particular, amino acid sequences and polypeptides of the invention are preferably such that they:
bind to an APC target or a T-cell target with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);
and/or such that they:
bind to an APC target or a T-cell target with a $k_{on}$-rate of between $10^2$ $M^{-1}$ $s^{-1}$ to about $10^7$ $M^{-1}$ $s^{-1}$, preferably between $10^3$ $M^{-1}$ $s^{-1}$ and $10^7$ $M^{-1}$ $s^{-1}$ more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$;
and/or such that they:
bind to an APC target or a T-cell target with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, a monovalent amino acid sequence of the invention (or a polypeptide that contains only one amino acid sequence of the invention) is preferably such that it will bind to an APC target or a T-cell target with an affinity less than 500 nM, preferably less than 200 nM, more preferably less than 10 nM, such as less than 500 pM.

Some preferred IC50 values for binding of the amino acid sequences or polypeptides of the invention to an APC target or a T-cell target will become clear from the further description and examples herein.

For binding to an APC target or a T-cell target, an amino acid sequence of the invention will usually contain within its amino acid sequence one or more amino acid residues or one or more stretches of amino acid residues (i.e. with each "stretch" comprising two or amino acid residues that are adjacent to each other or in close proximity to each other, i.e. in the primary or tertiary structure of the amino acid sequence) via which the amino acid sequence of the invention can bind to said APC target or said T-cell target, which amino acid residues or stretches of amino acid residues thus form the "site" for binding to said APC target or said T-cell target (also referred to herein as the "antigen binding site").

The amino acid sequences provided by the invention are preferably in essentially isolated form (as defined herein), or form part of a protein or polypeptide of the invention (as defined herein), which may comprise or essentially consist of one or more amino acid sequences of the invention and which may optionally further comprise one or more further amino acid sequences (all optionally linked via one or more suitable linkers). For example, and without limitation, the one or more amino acid sequences of the invention may be used as a binding unit in such a protein or polypeptide, which may optionally contain one or more further amino acid sequences that can serve as a binding unit (i.e. against one or more other targets than the one or more APC target or the one or more T-cell target), so as to provide a monovalent, multivalent or multispecific polypeptide of the invention, respectively, all as described herein. Such a protein or polypeptide may also be in essentially isolated form (as defined herein).

In one aspect of the invention, a polypeptide comprising only one amino acid of the invention may be advantageous and preferred over polypeptides comprising two or more amino acids of the invention. A monovalent (Fab) anti-CD80 monoclonal antibody, for example, proved to be much more efficient for improving EAE compared to the corresponding bivalent monoclonal antibody (Podojil et al., see supra). Therefore, in this preferred aspect, the invention relates to a monovalent polypeptide comprising only one amino acid sequence of the invention or else, to a multivalent or multispecific polypeptide comprising one amino acid of the invention and one or more other binding units (i.e. against one or more other targets than the one or more APC target or the one or more T-cell target) as further described herein.

The amino acid sequences and polypeptides of the invention as such preferably essentially consist of a single amino acid chain that is not linked via disulphide bridges to any other amino acid sequence or chain (but that may or may not contain one or more intramolecular disulphide bridges. For example, it is known that Nanobodies—as described herein—may sometimes contain a disulphide bridge between CDR3 and CDR1 or FR2). However, it should be noted that one or more amino acid sequences of the invention may be linked to each other and/or to other amino acid sequences (e.g. via disulphide bridges) to provide peptide constructs that may also be useful in the invention (for example Fab' fragments, F(ab')$_2$ fragments, ScFv constructs, "diabodies" and other multispecific constructs. Reference is for example made to the review by Holliger and Hudson, Nat Biotechnol. 2005 September; 23(9):1126-36).

Generally, when an amino acid sequence of the invention (or a compound, construct or polypeptide comprising the same) is intended for administration to a subject (for example for therapeutic and/or diagnostic purposes as described herein), it is preferably either an amino acid sequence that does not occur naturally in said subject; or, when it does occur naturally in said subject, in essentially isolated form (as defined herein).

It will also be clear to the skilled person that for pharmaceutical use, the amino acid sequences of the invention (as well as compounds, constructs and polypeptides comprising the same) are preferably directed against a human APC target or T-cell target; whereas for veterinary purposes, the amino acid sequences and polypeptides of the invention are preferably directed against an APC target or a T-cell target from the species to be treated, or at least cross-reactive with the APC target or T-cell target from the species to be treated.

Furthermore, an amino acid sequence of the invention may optionally, and in addition to the at least one binding site for binding against the APC target or T-cell target, contain one or more further binding sites for binding against other antigens, proteins or targets.

The efficacy of the amino acid sequences and polypeptides of the invention, and of compositions comprising the same, can be tested using any suitable in vitro assay, cell-based assay, in vivo assay and/or animal model known per se, or any combination thereof, depending on the specific disease or disorder involved. Suitable assays and animal models will be clear to the skilled person, and for example include binding assays such as surface plasmon resonance, e.g. implemented in the BIAcore (BIAcore AB, St. Albans, UK), the equilibrium binding assay as described by van der Merwe et al. (J. Exp. Med. 185: 393, 1997) and other binding assays such as for example described in Collins et al. (Immunity 17: 201, 2002); a T-cell activation assay as e.g. described in Podojil et al. J. Immunol. 177: 2948, 2006); animal models such as experimental autoimmune glomerulonephritis (EAG), an animal model of human anti-glomerular basement membrane (GBM) disease (Reynolds et al., J. Clin. Invest. 105: 643-51, 2000), the MRL-lpr/lpr mice, a model for lupus nephritis (Liang et al., J. Immunol. 165: 3436-43, 2000), experimental autoimmune encephalitis (EAE), an autoimmune model for MS (Kuchroo et al., Cell 80: 707-18, 1995; Podojil et al., J. Immunol. 177: 2948, 2006; Girvin et al., J. Immunol. 164: 136-43, 2000; Rottman et al., Nat. Immunol. 2: 605-611, 2001), susceptible nonobese diabetic (NOD) mice (Lenschow et al., J. Exp. Med. 181: 1145-55, 1995; Lenschow et al., Immunity 5: 285-93, 1996, Erratum in: Immunity 6(2): following 215, 1997), the cutaneous leishmaniasis model as described in Corry et al. (J. Immunol. 153: 4142-8, 1994), the Cardiac allograft rejection model described in Ozkaynak et al. (Nat. Immunol. 2: 591-6, 2001) and Furukawa et al. (Am. J. Pathol. 157: 473, 2000), the vaccinated primate model as described by Rollier et al. (2007, Hepatology 45: 602) and other models known to the skilled person such as referred to, for example, in Yamada et al., J. Am Soc. Nephrol. 13: 559, 2002, as well as the assays and animal models used in the experimental part below and in the prior art cited herein.

Also, according to the invention, amino acid sequences and polypeptides that are directed against an APC target or a T-cell target from a first species of warm-blooded animal may or may not show cross-reactivity with said APC target or a T-cell target from one or more other species of warm-blooded animal. For example, amino acid sequences and polypeptides directed against a human APC target or T-cell target may or may not show cross reactivity with an APC target or a T-cell target from one or more other species of primates (such as, without limitation, monkeys from the genus *Macaca* (such as, and in particular, cynomologus monkeys (*Macaca fascicularis*) and/or rhesus monkeys (*Macaca mulatta*)) and baboon (*Papio ursinus*)) and/or with an APC target or a T-cell target from one or more species of animals that are often used in animal models for diseases (for example mouse, rat, rabbit, pig or dog), and in particular in animal models for diseases and disorders associated with an APC target or a T-cell target (such as the species and animal models mentioned herein). In this respect, it will be clear to the skilled person that such cross-reactivity, when present, may have advantages from a drug development point of view, since it allows the amino acid sequences and polypeptides against a human APC target or T-cell target to be tested in such disease models.

More generally, amino acid sequences and polypeptides of the invention that are cross-reactive with an APC target or a T-cell target from multiple species of mammal will usually be advantageous for use in veterinary applications, since it will allow the same amino acid sequence or polypeptide to be used across multiple species. Thus, it is also encompassed within the scope of the invention that amino acid sequences and polypeptides directed against an APC target or a T-cell target from one species of animal (such as amino acid sequences and polypeptides against a human APC target or T-cell target) can be used in the treatment of another species of animal, as long as the use of the amino acid sequences and/or polypeptides provide the desired effects in the species to be treated.

The present invention is in its broadest sense also not particularly limited to or defined by a specific antigenic determinant, epitope, part, domain, subunit or confirmation (where applicable) of an APC target or a T-cell target against which the amino acid sequences and polypeptides of the invention are directed. For example, the amino acid sequences and polypeptides may or may not be directed against an "interaction site" (as defined herein). However, it is generally assumed and preferred that the amino acid sequences and polypeptides of the invention are preferably directed against an interaction site (as defined herein), and in particular against the site on their target by which said target interacts with its receptor or ligand, i.e. e.g. for B7-1 and B7-2, the site on B7-1 and B7-2 respectively that interacts with CD28 or the site on B7-1 and B7-2 respectively that interacts with CTLA4 (Ellis et al. J. Immunol. 156(8): 2700-9, 1996; Stamper et al., Nature 410: 608-11, 2001, Erratum in: Nature 411: 617, 2001; Schwartz et al., Nature 410: 604-8, 2001; Ikemizu et al., Immunity. 12(1): 51-60, 2000; Zhang et al., Proc. Nat. Acad. Sci. 100: 2586, 2003), for B7RP-1, the site on B7RP-1 that interacts with ICOS, for PD-L1 and PD-L2, the site on PD-L1 and PD-L2 respectively that interacts with PD-1 and for B7H-3 and B7x, the site on B7H-3 and B7x respectively that interacts with BTLA, for CD28, the site on CD28 that interacts with B7-1 and/or B7-2, for CTLA4, the site on CTLA4 that interacts with B7-1 and/or B7-2, for ICOS, the site on ICOS that interacts with B7RP-1, for PD-1, the site on PD-1 that interacts with PD-L1 and/or PD-L2, for BTLA, the site on BTLA that interacts with B7H-3 and/or B7x. Thus, in one preferred, but non-limiting aspect, the amino acid sequences and polypeptides of the invention are directed against the site on the APC target or on the T-cell target by which said target interacts with its receptor or ligand respectively, and are as further defined herein.

Else, the amino acid sequences and polypeptides of the invention are preferably directed against a site on their target in the proximity of the site by which said target interacts with its receptor or ligand respectively, as to provide some sterical hindrance for the interaction of the target with its receptor or ligand. Preferably, the site against which the amino acids and polypeptides of the invention are directed is such that binding of the target to its receptor or ligand is modulated, and in particular inhibited or prevented.

In a specific aspect of the invention, the amino acid sequences and polypeptides of the invention are directed against a site on B7-1 such that the interaction of B7-1 with CD28 is modulated, and in particular inhibited or prevented. In another aspect of the invention, the amino acid sequences and polypeptides of the invention are directed against a site on B7-1, such that the interaction of B7-1 with CTLA4 is modulated, and in particular inhibited or prevented. In another aspect of the invention, the amino acid sequences and polypeptides of the invention are directed against a site on B7-1 such that the interaction of B7-1 with CD28 and the interaction of B7-1 with CTLA4 is modulated, and in particular inhibited or prevented. In another aspect of the invention, the amino acid sequences and polypeptides of the invention are directed against a site on B7-1, such that the interaction of B7-1 with CD28 is modulated, and in particular inhibited or prevented while the interaction of B7-1 with CTLA4 is not modulated, and in particular inhibited or prevented. In another aspect of the invention, the amino acid sequences and polypeptides of the invention are directed against a site on B7-1 such that the interaction of B7-1 with CTLA4 is modulated, and in particular inhibited or prevented while the interaction of B7-1 with CD28 is not modulated, and in particular inhibited or prevented.

In another specific aspect of the invention, the amino acid sequences and polypeptides of the invention are directed against a site on B7-2 such that the interaction of B7-2 with CD28 is modulated, and in particular inhibited or prevented. In another aspect of the invention, the amino acid sequences and polypeptides of the invention are directed against a site on B7-2, such that the interaction of B7-2 with CTLA4 is modulated, and in particular inhibited or prevented. In another aspect of the invention, the amino acid sequences and polypeptides of the invention are directed against a site on B7-2 such that the interaction of B7-2 with CD28 and the interaction of B7-2 with CTLA4 is modulated, and in particular inhibited or prevented. In another aspect of the invention, the amino acid sequences and polypeptides of the invention are directed against a site on B7-2, such that the interaction of B7-2 with CD28 is modulated, and in particular inhibited or prevented while the interaction of B7-2 with CTLA4 is not modulated, and in particular inhibited or prevented. In another aspect of the invention, the amino acid sequences and polypeptides of the invention are directed against a site on B7-2 such that the interaction of B7-2 with CTLA4 is modulated, and in particular inhibited or prevented while the interaction of B7-2 with CD28 is not modulated, and in particular inhibited or prevented.

In another specific aspect of the invention, the amino acid sequences and polypeptides of the invention are directed against a site on CD28 such that the interaction of CD28 with B7-1 is modulated, and in particular inhibited or prevented. In another aspect of the invention, the amino acid sequences and polypeptides of the invention are directed against a site on CD28, such that the interaction of CD28 with B7-2 is modulated, and in particular inhibited or prevented. In another aspect of the invention, the amino acid sequences and polypeptides of the invention are directed against a site on CD28 such that the interaction of CD28 with B7-1 and the interaction of CD28 with B7-2 is modulated, and in particular inhibited or prevented. In another aspect of the invention, the amino acid sequences and polypeptides of the invention are directed against a site on CD28, such that the interaction of CD28 with B7-1 is modulated, and in particular inhibited or prevented while the interaction of CD28 with B7-2 is not modulated, and in particular inhibited or prevented. In another aspect of the invention, the amino acid sequences and polypeptides of the invention are directed against a site on CD28 such that the interaction of CD28 with B7-2 is modulated, and in particular inhibited or prevented while the interaction of CD28 with B7-1 is not modulated, and in particular inhibited or prevented.

In another specific aspect of the invention, the amino acid sequences and polypeptides of the invention are directed against a site on CTLA4 such that the interaction of CTLA4 with B7-1 is modulated, and in particular inhibited or prevented. In another aspect of the invention, the amino acid sequences and polypeptides of the invention are directed against a site on CTLA4, such that the interaction of CTLA4 with B7-2 is modulated, and in particular inhibited or prevented. In another aspect of the invention, the amino acid sequences and polypeptides of the invention are directed against a site on CTLA4 such that the interaction of CTLA4 with B7-1 and the interaction of CTLA4 with B7-2 is modulated, and in particular inhibited or prevented. In another aspect of the invention, the amino acid sequences and polypeptides of the invention are directed against a site on CTLA4, such that the interaction of CTLA4 with B7-1 is modulated, and in particular inhibited or prevented while the interaction of CTLA4 with B7-2 is not modulated, and in particular inhibited or prevented. In another aspect of the invention, the amino acid sequences and polypeptides of the invention are directed against a site on CTLA4 such that the interaction of CTLA4 with B7-2 is modulated, and in particular inhibited or prevented while the interaction of CTLA4 with B7-1 is not modulated, and in particular inhibited or prevented.

In another specific aspect of the invention, the amino acid sequences and polypeptides of the invention are directed against a site on B7RP-1 or ICOS such that the interaction of B7RP-1 with ICOS is modulated, and in particular inhibited or prevented.

In another aspect of the invention, the amino acid sequences and polypeptides of the invention are directed against a site on PD-L1 or PD-L2 such that the interaction of respectively PD-L1 or PD-L2 with PD-1 is modulated, and in particular inhibited or prevented.

In another aspect of the invention, the amino acid sequences and polypeptides of the invention are directed against a site on PD-1 such that the interaction of PD-1 with PD-L1 is modulated, and in particular inhibited or prevented. In another aspect of the invention, the amino acid sequences and polypeptides of the invention are directed against a site on PD-1 such that the interaction of PD-1 with PD-L2 is modulated, and in particular inhibited or prevented. In another aspect of the invention, the amino acid sequences and polypeptides of the invention are directed against a site on PD-1 such that the interaction of PD-1 with PD-L1 is modulated, and in particular inhibited or prevented and that the interaction of PD-1 with PD-L2 is modulated, and in particular inhibited or prevented. In another aspect of the invention, the amino acid sequences and polypeptides of the invention are directed against a site on PD-1 such that the interaction of PD-1 with PD-L1 is modulated, and in particular inhibited or prevented while the interaction of PD-1 with PD-L2 is not modulated, and in particular inhibited or prevented. In another aspect of the invention, the amino acid sequences and polypeptides of the invention are directed against a site on PD-1 such that the interaction of PD-1 with PD-L2 is modulated, and in particular inhibited or prevented while the interaction of PD-1 with PD-L1 is modulated, and in particular inhibited or prevented.

In another aspect of the invention, the amino acid sequences and polypeptides of the invention are directed against a site on B7H-3 or B7x such that the interaction of respectively B7H-3 or B7x with BTLA is modulated, and in particular inhibited or prevented.

In another aspect of the invention, the amino acid sequences and polypeptides of the invention are directed against a site on BTLA such that the interaction of BTLA with B7H-3 is modulated, and in particular inhibited or prevented. In another aspect of the invention, the amino acid sequences and polypeptides of the invention are directed against a site on BTLA such that the interaction of BTLA with B7x is modulated, and in particular inhibited or prevented. In another aspect of the invention, the amino acid sequences and polypeptides of the invention are directed against a site on BTLA such that the interaction of BTLA with B7H-3 is modulated, and in particular inhibited or prevented and the interaction of BTLA with B7x is modulated, and in particular inhibited or prevented. In another aspect of the invention, the amino acid sequences and polypeptides of the invention are directed against a site on BTLA such that the interaction of BTLA with B7H-3 is modulated, and in particular inhibited or prevented while the interaction of BTLA with B7x is not modulated, and in particular inhibited or prevented. In another aspect of the invention, the amino acid sequences and polypeptides of the invention are directed against a site on BTLA such that the interaction of BTLA with B7x is modulated, and in particular inhibited or prevented while the interaction of BTLA with B7H-3 is not modulated, and in particular inhibited or prevented.

As further described herein, a polypeptide of the invention may contain two or more amino acid sequences of the invention that are directed against an APC target or a T-cell target. Generally, such polypeptides will bind to the APC target or a T-cell with increased avidity compared to a single amino acid sequence of the invention. Such a polypeptide may for example comprise two amino acid sequences of the invention that are directed against the same antigenic determinant, epitope, part, domain, subunit or confirmation (where applicable) of the APC target or a T-cell (which may or may not be an interaction site); or comprise at least one "first" amino acid sequence of the invention that is directed against a first antigenic determinant, epitope, part, domain, subunit or confirmation (where applicable) of the APC target or a T-cell (which may or may not be an interaction site); and at least one "second" amino acid sequence of the invention that is directed against a second antigenic determinant, epitope, part, domain, subunit or confirmation (where applicable) different from the first (and which again may or may not be an interaction site). Preferably, in such "biparatopic" polypeptides of the invention, at least one amino acid sequence of the invention is directed against an interaction site (as defined herein), although the invention in its broadest sense is not limited thereto.

Also, when the target is part of a binding pair (for example, a receptor-ligand binding pair), the amino acid sequences and polypeptides may be such that they compete with the cognate binding partner (e.g. the ligand, receptor or other binding partner, as applicable) for binding to the target, and/or such that they (fully or partially) neutralize binding of the binding partner to the target.

It is also within the scope of the invention that, where applicable, an amino acid sequence of the invention can bind to two or more antigenic determinants, epitopes, parts, domains, subunits or confirmations of an APC target or a T-cell target. In such a case, the antigenic determinants, epitopes, parts, domains or subunits of the APC target or T-cell target to which the amino acid sequences and/or polypeptides of the invention bind may be essentially the same (for example, if the APC target or T-cell target contains repeated structural motifs or occurs in a multimeric form) or may be different (and in the latter case, the amino acid sequences and polypeptides of the invention may bind to such different antigenic determinants, epitopes, parts, domains, subunits of the APC target or T-cell target with an affinity and/or specificity which may be the same or different). Also, for example, when an APC target or a T-cell target exists in an activated conformation and in an inactive conformation, the amino acid sequences and polypeptides of the invention may bind to either one of these confirmation, or may bind to both these confirmations (i.e. with an affinity and/or specificity which may be the same or different). Also, for example, the amino acid sequences and polypeptides of the invention may bind to a conformation of an APC target or a T-cell target in which it is bound to a pertinent ligand, may bind to a conformation of an APC target or a T-cell target in which it not bound to a pertinent ligand, or may bind to both such conformations (again with an affinity and/or specificity which may be the same or different).

It is also expected that the amino acid sequences and polypeptides of the invention will generally bind to all naturally occurring or synthetic analogs, variants, mutants, alleles, parts and fragments of an APC target or a T-cell target; or at least to those analogs, variants, mutants, alleles, parts and fragments of an APC target or a T-cell target that contain one or more antigenic determinants or epitopes that are essentially the same as the antigenic determinant(s) or epitope(s) to which the amino acid sequences and polypeptides of the invention bind in the APC target or T-cell target (e.g. in wild-type APC target or T-cell target). Again, in such a case, the amino acid sequences and polypeptides of the invention may bind to such analogs, variants, mutants, alleles, parts and fragments with an affinity and/or specificity that are the same as, or that are different from (i.e. higher than or lower than), the affinity and specificity with which the amino acid sequences of the invention bind to (wild-type) APC target or T-cell target. It is also included within the scope of the invention that the amino acid sequences and polypeptides of the invention bind to some analogs, variants, mutants, alleles, parts and fragments of an APC target or a T-cell target, but not to others.

When an APC target or a T-cell target exists in a monomeric form and in one or more multimeric forms, it is within the scope of the invention that the amino acid sequences and polypeptides of the invention only bind to the APC target or T-cell target in monomeric form, only bind to the APC target or T-cell target in multimeric form, or bind to both the monomeric and the multimeric form. Again, in such a case, the amino acid sequences and polypeptides of the invention may bind to the monomeric form with an affinity and/or specificity that are the same as, or that are different from (i.e. higher than or lower than), the affinity and specificity with which the amino acid sequences of the invention bind to the multimeric form.

Also, when the APC target or T-cell target can associate with other proteins or polypeptides to form protein complexes (e.g. with multiple subunits), it is within the scope of the invention that the amino acid sequences and polypeptides of the invention bind to the APC target or T-cell target in its non-associated state, bind to the APC target or T-cell target in its associated state, or bind to both. In all these cases, the amino acid sequences and polypeptides of the invention may bind to such multimers or associated protein complexes with an affinity and/or specificity that may be the same as or different from (i.e. higher than or lower than) the affinity and/or specificity with which the amino acid sequences and polypeptides of the invention bind to the APC target or T-cell target in its monomeric and non-associated state.

Also, as will be clear to the skilled person, proteins or polypeptides that contain two or more amino acid sequences directed against an APC target or a T-cell target may bind with higher avidity to the APC target or T-cell target than the corresponding monomeric amino acid sequence(s). For example, and without limitation, proteins or polypeptides that contain two or more amino acid sequences directed against different epitopes of an APC target or a T-cell target may (and usually will) bind with higher avidity than each of the different monomers, and proteins or polypeptides that contain two or more amino acid sequences directed against the APC target or T-cell target may (and usually will) bind also with higher avidity to a multimer of the APC target or T-cell target.

Generally, amino acid sequences and polypeptides of the invention will at least bind to those forms of the APC target or T-cell target (including monomeric, multimeric and associated forms) that are the most relevant from a biological and/or therapeutic point of view, as will be clear to the skilled person.

It is also within the scope of the invention to use parts, fragments, analogs, mutants, variants, alleles and/or derivatives of the amino acid sequences and polypeptides of the invention, and/or to use proteins or polypeptides comprising or essentially consisting of one or more of such parts, fragments, analogs, mutants, variants, alleles and/or derivatives, as long as these are suitable for the uses envisaged herein. Such parts, fragments, analogs, mutants, variants, alleles and/or derivatives will usually contain (at least part of) a functional antigen-binding site for binding against the APC target or T-cell target; and more preferably will be capable of specific binding to the APC target or T-cell target, and even more preferably capable of binding to the APC target or T-cell target with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein. Some non-limiting examples of such parts, fragments, analogs, mutants, variants, alleles, derivatives, proteins and/or polypeptides will become clear from the further description herein. Additional fragments or polypeptides of the invention may also be provided by suitably combining (i.e. by linking or genetic fusion) one or more (smaller) parts or fragments as described herein.

In one specific, but non-limiting aspect of the invention, which will be further described herein, such analogs, mutants, variants, alleles, derivatives have an increased half-life in serum (as further described herein) compared to the amino acid sequence from which they have been derived. For example, an amino acid sequence of the invention may be linked (chemically or otherwise) to one or more groups or moieties that extend the half-life (such as PEG), so as to provide a derivative of an amino acid sequence of the invention with increased half-life.

In one specific, but non-limiting aspect, the amino acid sequence of the invention may be an amino acid sequence that comprises an immunoglobulin fold or may be an amino acid sequence that, under suitable conditions (such as physiological conditions) is capable of forming an immunoglobulin fold (i.e. by folding). Reference is inter alia made to the review by Halaby et al., J. (1999) Protein Eng. 12, 563-71. Preferably, when properly folded so as to form an immunoglobulin fold, such an amino acid sequence is capable of specific binding (as defined herein) to the APC target or T-cell target; and more preferably capable of binding to the APC target or T-cell target with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein. Also, parts, fragments, analogs, mutants, variants, alleles and/or derivatives of such amino acid sequences are preferably such that they comprise an immunoglobulin fold or are capable for forming, under suitable conditions, an immunoglobulin fold.

In particular, but without limitation, the amino acid sequences of the invention may be amino acid sequences that essentially consist of 4 framework regions (FR1 to FR4 respectively) and 3 complementarity determining regions (CDR1 to CDR3 respectively); or any suitable fragment of such an amino acid sequence (which will then usually contain at least some of the amino acid residues that form at least one of the CDR's, as further described herein).

The amino acid sequences of the invention may in particular be an immunoglobulin sequence or a suitable fragment thereof, and more in particular be an immunoglobulin variable domain sequence or a suitable fragment thereof, such as light chain variable domain sequence (e.g. a $V_L$-sequence) or a suitable fragment thereof; or a heavy chain variable domain sequence (e.g. a $V_H$-sequence) or a suitable fragment thereof. When the amino acid sequence of the invention is a heavy chain variable domain sequence, it may be a heavy chain variable domain sequence that is derived from a conventional four-chain antibody (such as, without limitation, a $V_H$ sequence that is derived from a human antibody) or be a so-called $V_{HH}$-sequence (as defined herein) that is derived from a so-called "heavy chain antibody" (as defined herein).

However, it should be noted that the invention is not limited as to the origin of the amino acid sequence of the invention (or of the nucleotide sequence of the invention used to express it), nor as to the way that the amino acid sequence or nucleotide sequence of the invention is (or has been) generated or obtained. Thus, the amino acid sequences of the invention may be naturally occurring amino acid sequences (from any suitable species) or synthetic or semi-synthetic amino acid sequences. In a specific but non-limiting aspect of the invention, the amino acid sequence is a naturally occurring immunoglobulin sequence (from any suitable species) or a synthetic or semi-synthetic immunoglobulin sequence, including but not limited to "humanized" (as defined herein) immunoglobulin sequences (such as partially or fully humanized mouse or rabbit immunoglobulin sequences, and in particular partially or fully humanized $V_{HH}$ sequences or Nanobodies), "camelized" (as defined herein) immunoglobulin sequences, as well as immunoglobulin sequences that have been obtained by techniques such as affinity maturation (for example, starting from synthetic, random or naturally occurring immunoglobulin sequences), CDR grafting, veneering, combining fragments derived from different immunoglobulin sequences, PCR assembly using overlapping primers, and similar techniques for engineering immunoglobulin sequences well known to the skilled person; or any suitable combination of any of the foregoing. Reference is for example made to the standard handbooks, as well as to the further description and prior art mentioned herein.

Similarly, the nucleotide sequences of the invention may be naturally occurring nucleotide sequences or synthetic or semi-synthetic sequences, and may for example be sequences that are isolated by PCR from a suitable naturally occurring template (e.g. DNA or RNA isolated from a cell), nucleotide sequences that have been isolated from a library (and in particular, an expression library), nucleotide sequences that have been prepared by introducing mutations into a naturally occurring nucleotide sequence (using any suitable technique known per se, such as mismatch PCR), nucleotide sequence that have been prepared by PCR using overlapping primers, or nucleotide sequences that have been prepared using techniques for DNA synthesis known per se.

The amino acid sequence of the invention may in particular be a domain antibody (or an amino acid sequence that is suitable for use as a domain antibody), a single domain antibody (or an amino acid sequence that is suitable for use as a single domain antibody), a "dAb" (or an amino acid sequence that is suitable for use as a dAb) or a Nanobody® (as defined herein, and including but not limited to a $V_{HH}$ sequence); other single variable domains, or any suitable fragment of any one thereof. For a general description of (single) domain antibodies, reference is also made to the prior art cited above, as well as to EP 0 368 684. For the term "dAb's", reference is for example made to Ward et al. (Nature 1989 Oct. 12; 341 (6242): 544-6), to Holt et al., Trends Biotechnol., 2003, 21(11):484-490; as well as to for example WO 06/030220, WO 06/003388 and other published patent applications of Domantis Ltd. It should also be noted that, although less preferred in the context of the present invention because they are not of mammalian origin, single domain antibodies or single variable domains can be derived from certain species of shark (for example, the so-called "IgNAR domains", see for example WO 05/18629).

In particular, the amino acid sequence of the invention may be a Nanobody® (as defined herein) or a suitable fragment thereof. [Note: Nanobody®, Nanobodies® and Nanoclone® are registered trademarks of Ablynx N.V.] Such Nanobodies directed against an APC target or a T-cell target will also be referred to herein as "Nanobodies of the invention".

For a general description of Nanobodies, reference is made to the further description below, as well as to the prior art cited herein. In this respect, it should however be noted that this description and the prior art mainly described Nanobodies of the so-called "$V_H3$ class" (i.e. Nanobodies with a high degree of sequence homology to human germline sequences of the $V_H3$ class such as DP-47, DP-51 or DP-29), which Nanobodies form a preferred aspect of this invention. It should however be noted that the invention in its broadest sense generally covers any type of Nanobody directed against an APC target or a T-cell target, and for example also covers the Nanobodies belonging to the so-called "$V_H4$ class" (i.e. Nanobodies with a high degree of sequence homology to human germline sequences of the $V_H4$ class such as DP-78), as for example described in the U.S. provisional application 60/792,279 by Ablynx N. V. entitled "DP-78-like Nanobodies" filed on Apr. 14, 2006 (see also PCT/EP2007/003259).

Generally, Nanobodies (in particular $V_{HH}$ sequences and partially humanized Nanobodies) can in particular be characterized by the presence of one or more "Hallmark residues" (as described herein) in one or more of the framework sequences (again as further described herein).

Thus, generally, a Nanobody can be defined as an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which one or more of the Hallmark residues are as further defined herein.

In particular, a Nanobody can be an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which the framework sequences are as further defined herein.

More in particular, a Nanobody can be an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) preferably one or more of the amino acid residues at positions 11, 37, 44, 45, 47, 83, 84, 103, 104 and 108 according to the Kabat numbering are chosen from the Hallmark residues mentioned in Table A-3 below;

and in which:

ii) said amino acid sequence has at least 80% amino acid identity with at least one of the amino acid sequences of SEQ ID NO's: 1 to 22, in which for the purposes of determining the degree of amino acid identity, the amino acid residues that form the CDR sequences (indicated with X in the sequences of SEQ ID NO's: 1 to 22) are disregarded.

In these Nanobodies, the CDR sequences are generally as further defined herein.

Thus, the invention also relates to such Nanobodies that can bind to (as defined herein) and/or are directed against an APC target or a T-cell target, to suitable fragments thereof, as well as to polypeptides that comprise or essentially consist of one or more of such Nanobodies and/or suitable fragments.

In a preferred aspect of the invention, Nanobodies are raised against B7-1 and B7-2. SEQ ID NO's: 266-285 give the amino acid sequences of a number of $V_{HH}$ sequences that have been raised against B7-1 and B7-2.

In particular, the invention in some specific aspects provides:

amino acid sequences that are directed against (as defined herein) B7-1 and/or B7-2 and that have at least 80%, preferably at least 85%, such as 90% or 95% or more sequence identity with at least one of the amino acid sequences of SEQ ID NO's: 266-285. These amino acid sequences may further be such that they neutralize binding of the cognate ligand to B7-1 and/or B7-2; and/or compete with the cognate ligand for binding to B7-1 and/or B7-2; and/or are directed against an interaction site (as defined herein) on B7-1 and/or B7-2 (such as the ligand binding site);

amino acid sequences that cross-block (as defined herein) the binding of at least one of the amino acid sequences of SEQ ID NO's: 266-285 to B7-1 and/or B7-2 and/or that compete with at least one of the amino acid sequences of SEQ ID NO's: 266-285 for binding to B7-1 and/or B7-2. Again, these amino acid sequences may further be such that they neutralize binding of the cognate ligand to B7-1 and/or B7-2; and/or compete with the cognate ligand for binding to B7-1 and/or B7-2; and/or are directed against an interaction site (as defined herein) on B7-1 and/or B7-2 (such as the ligand binding site);

which amino acid sequences may be as further described herein (and may for example be Nanobodies); as well as polypeptides of the invention that comprise one or more of such amino acid sequences (which may be as further described herein, and may for example be bispecific and/or biparatopic polypeptides as described herein), and nucleic acid sequences that encode such amino acid sequences and polypeptides. Such amino acid sequences and polypeptides do not include any naturally occurring ligands.

In some other specific aspects, the invention provides:
amino acid sequences of the invention that are specific for (as defined herein) B7-1 compared to B7-2;
amino acid sequences of the invention that are specific for B7-2 compared to B7-1;
which amino acid sequences of the invention may be as further described herein (and may for example be Nanobodies); as well as polypeptides of the invention that comprise one or more of such amino acid sequences (which may be as further described herein, and may for example be bispecific and/or biparatopic polypeptides as described herein), and nucleic acid sequences that encode such amino acid sequences and polypeptides. Such amino acid sequences and polypeptides do not include any naturally occurring ligands.

Accordingly, some particularly preferred Nanobodies of the invention are Nanobodies which can bind (as further defined herein) to and/or are directed against B7-1 and/or B7-2 and which:
i) have at least 80% amino acid identity with at least one of the amino acid sequences of SEQ ID NO's: 266-285, in which for the purposes of determining the degree of amino acid identity, the amino acid residues that form the CDR sequences are disregarded. In this respect, reference is also made to Table A-1a, which lists the framework 1 sequences (SEQ ID NO's: 126-145), framework 2 sequences (SEQ ID NO's: 166-185), framework 3 sequences (SEQ ID NO's: 206-225) and framework 4 sequences (SEQ ID NO's: 246-265) of the Nanobodies of SEQ ID NO's: 266-285 (with respect to the amino acid residues at positions 1 to 4 and 27 to 30 of the framework 1 sequences, reference is also made to the comments made below. Thus, for determining the degree of amino acid identity, these residues are preferably disregarded);
and in which:
ii) preferably one or more of the amino acid residues at positions 11, 37, 44, 45, 47, 83, 84, 103, 104 and 108 according to the Kabat numbering are chosen from the Hallmark residues mentioned in Table A-3 below.

In these Nanobodies, the CDR sequences are generally as further defined herein.

In another preferred aspect of the invention, Nanobodies are raised against PD-1. SEQ ID NO's: 347-351 give the amino acid sequences of a number of $V_{HH}$ sequences that have been raised against PD-1.

In particular, the invention in some specific aspects provides:
amino acid sequences that are directed against (as defined herein) PD-1 and that have at least 80%, preferably at least 85%, such as 90% or 95% or more sequence identity with at least one of the amino acid sequences of SEQ ID NO's: 347-351. These amino acid sequences may further be such that they neutralize binding of the cognate ligand to PD-1; and/or compete with the cognate ligand for binding to PD-1; and/or are directed against an interaction site (as defined herein) on PD-1 (such as the ligand binding site);
amino acid sequences that cross-block (as defined herein) the binding of at least one of the amino acid sequences of SEQ ID NO's: 347-351 to PD-1 and/or that compete with at least one of the amino acid sequences of SEQ ID NO's: 347-351 for binding to PD-1. Again, these amino acid sequences may further be such that they neutralize binding of the cognate ligand to PD-1; and/or compete with the cognate ligand for binding to PD-1; and/or are directed against an interaction site (as defined herein) on PD-1 (such as the ligand binding site);
which amino acid sequences may be as further described herein (and may for example be Nanobodies); as well as polypeptides of the invention that comprise one or more of such amino acid sequences (which may be as further described herein, and may for example be bispecific and/or biparatopic polypeptides as described herein), and nucleic acid sequences that encode such amino acid sequences and polypeptides. Such amino acid sequences and polypeptides do not include any naturally occurring ligands.

Accordingly, some particularly preferred Nanobodies of the invention are Nanobodies which can bind (as further defined herein) to and/or are directed against to PD-1 and which:
i) have at least 80% amino acid identity with at least one of the amino acid sequences of SEQ ID NO's: 347-351, in which for the purposes of determining the degree of amino acid identity, the amino acid residues that form the CDR sequences are disregarded. In this respect, reference is also made to Table A-1b, which lists the framework 1 sequences (SEQ ID NO's: 312-316), framework 2 sequences (SEQ ID NO's: 322-326), framework 3 sequences (SEQ ID NO's: 332-336) and framework 4 sequences (SEQ ID NO's: 342-346) of the Nanobodies of SEQ ID NO's: 347-351 (with respect to the amino acid residues at positions 1 to 4 and 27 to 30 of the framework 1 sequences, reference is also made to the comments made below. Thus, for determining the degree of amino acid identity, these residues are preferably disregarded);
and in which:
ii) preferably one or more of the amino acid residues at positions 11, 37, 44, 45, 47, 83, 84, 103, 104 and 108 according to the Kabat numbering are chosen from the Hallmark residues mentioned in Table A-3 below.

In these Nanobodies, the CDR sequences are generally as further defined herein.

In another preferred aspect of the invention, Nanobodies are raised against PD-L1. SEQ ID NO's: 394-399 give the amino acid sequences of a number of $V_{HH}$ sequences that have been raised against PD-L1.

In particular, the invention in some specific aspects provides:
amino acid sequences that are directed against (as defined herein) PD-L1 and that have at least 80%, preferably at least 85%, such as 90% or 95% or more sequence identity with at least one of the amino acid sequences of SEQ ID NO's: 394-399. These amino acid sequences may further be such that they neutralize binding of the cognate ligand to PD-L1; and/or compete with the cognate ligand for binding to PD-L1; and/or are directed against an interaction site (as defined herein) on PD-L1 (such as the ligand binding site);
amino acid sequences that cross-block (as defined herein) the binding of at least one of the amino acid sequences of SEQ ID NO's: 394-399 to PD-L1 and/or that compete with at least one of the amino acid sequences of SEQ ID NO's: 394-399 for binding to PD-L1. Again, these amino acid sequences may further be such that they neutralize binding of the cognate ligand to PD-L1; and/ or compete with the cognate ligand for binding to PD- L1; and/or are directed against an interaction site (as defined herein) on PD-L1 (such as the ligand binding site);

which amino acid sequences may be as further described herein (and may for example be Nanobodies); as well as polypeptides of the invention that comprise one or more of such amino acid sequences (which may be as further described herein, and may for example be bispecific and/or biparatopic polypeptides as described herein), and nucleic acid sequences that encode such amino acid sequences and polypeptides. Such amino acid sequences and polypeptides do not include any naturally occurring ligands.

In some other specific aspects, the invention provides:
amino acid sequences of the invention that are specific for (as defined herein) PD-L1 compared to PD-L2;

which amino acid sequences of the invention may be as further described herein (and may for example be Nanobodies); as well as polypeptides of the invention that comprise one or more of such amino acid sequences (which may be as further described herein, and may for example be bispecific and/or biparatopic polypeptides as described herein), and nucleic acid sequences that encode such amino acid sequences and polypeptides. Such amino acid sequences and polypeptides do not include any naturally occurring ligands.

Accordingly, some particularly preferred Nanobodies of the invention are Nanobodies which can bind (as further defined herein) to and/or are directed against PD-L1 and which:

i) have at least 80% amino acid identity with at least one of the amino acid sequences of SEQ ID NO's: 394-399, in which for the purposes of determining the degree of amino acid identity, the amino acid residues that form the CDR sequences are disregarded. In this respect, reference is also made to Table A-1c, which lists the framework 1 sequences (SEQ ID NO's: 352-357), framework 2 sequences (SEQ ID NO's: 364-369), framework 3 sequences (SEQ ID NO's: 376-381) and framework 4 sequences (SEQ ID NO's: 388-393) of the Nanobodies of SEQ ID NO's: 394-399 (with respect to the amino acid residues at positions 1 to 4 and 27 to 30 of the framework 1 sequences, reference is also made to the comments made below. Thus, for determining the degree of amino acid identity, these residues are preferably disregarded);

and in which:

ii) preferably one or more of the amino acid residues at positions 11, 37, 44, 45, 47, 83, 84, 103, 104 and 108 according to the Kabat numbering are chosen from the Hallmark residues mentioned in Table A-3 below.

In these Nanobodies, the CDR sequences are generally as further defined herein.

In another preferred aspect of the invention, Nanobodies are raised against PD-L2. SEQ ID NO's: 449-455 give the amino acid sequences of a number of $V_{HH}$ sequences that have been raised against PD-L2.

In particular, the invention in some specific aspects provides:
amino acid sequences that are directed against (as defined herein) PD-L2 and that have at least 80%, preferably at least 85%, such as 90% or 95% or more sequence identity with at least one of the amino acid sequences of SEQ ID NO's: 449-455. These amino acid sequences may further be such that they neutralize binding of the cognate ligand to PD-L2; and/or compete with the cognate ligand for binding to PD-L2; and/or are directed against an interaction site (as defined herein) on PD-L2 (such as the ligand binding site); amino acid sequences that cross-block (as defined herein) the binding of at least one of the amino acid sequences of SEQ ID NO's: 449-455 to PD-L2 and/or that compete with at least one of the amino acid sequences of SEQ ID NO's: 449-455 for binding to PD-L2. Again, these amino acid sequences may further be such that they neutralize binding of the cognate ligand to PD-L2; and/or compete with the cognate ligand for binding to PD-L2; and/or are directed against an interaction site (as defined herein) on PD-L2 (such as the ligand binding site);

which amino acid sequences may be as further described herein (and may for example be Nanobodies); as well as polypeptides of the invention that comprise one or more of such amino acid sequences (which may be as further described herein, and may for example be bispecific and/or biparatopic polypeptides as described herein), and nucleic acid sequences that encode such amino acid sequences and polypeptides. Such amino acid sequences and polypeptides do not include any naturally occurring ligands.

In some other specific aspects, the invention provides:
amino acid sequences of the invention that are specific for (as defined herein) PD-L2 compared to PD-L1;

which amino acid sequences of the invention may be as further described herein (and may for example be Nanobodies); as well as polypeptides of the invention that comprise one or more of such amino acid sequences (which may be as further described herein, and may for example be bispecific and/or biparatopic polypeptides as described herein), and nucleic acid sequences that encode such amino acid sequences and polypeptides. Such amino acid sequences and polypeptides do not include any naturally occurring ligands.

Accordingly, some particularly preferred Nanobodies of the invention are Nanobodies which can bind (as further defined herein) to and/or are directed against PD-L2 and which:

i) have at least 80% amino acid identity with at least one of the amino acid sequences of SEQ ID NO's: 449-455, in which for the purposes of determining the degree of amino acid identity, the amino acid residues that form the CDR sequences are disregarded. In this respect, reference is also made to Table A-1d, which lists the framework 1 sequences (SEQ ID NO's: 400-406), framework 2 sequences (SEQ ID NO's: 414-420), framework 3 sequences (SEQ ID NO's: 428-434) and framework 4 sequences (SEQ ID NO's: 442-448) of the Nanobodies of SEQ ID NO's: 449-455 (with respect to the amino acid residues at positions 1 to 4 and 27 to 30 of the framework 1 sequences, reference is also made to the comments made below. Thus, for determining the degree of amino acid identity, these residues are preferably disregarded);

and in which:

ii) preferably one or more of the amino acid residues at positions 11, 37, 44, 45, 47, 83, 84, 103, 104 and 108 according to the Kabat numbering are chosen from the Hallmark residues mentioned in Table A-3 below.

In these Nanobodies, the CDR sequences are generally as further defined herein.

In another preferred aspect of the invention, Nanobodies are raised against ICOSL. SEQ ID NO's: 505-511 give the amino acid sequences of a number of $V_{HH}$ sequences that have been raised against ICOSL.

In particular, the invention in some specific aspects provides:
amino acid sequences that are directed against (as defined herein) ICOSL and that have at least 80%, preferably at least 85%, such as 90% or 95% or more sequence identity with at least one of the amino acid sequences of SEQ ID NO's: 505-511. These amino acid sequences may further be such that they neutralize binding of the cognate ligand to ICOSL; and/or compete with the cognate ligand for binding to ICOSL; and/or are directed against an interaction site (as defined herein) on ICOSL (such as the ligand binding site);

amino acid sequences that cross-block (as defined herein) the binding of at least one of the amino acid sequences of SEQ ID NO's: 505-511 to ICOSL and/or that compete with at least one of the amino acid sequences of SEQ ID NO's: 505-511 for binding to ICOSL. Again, these amino acid sequences may further be such that they neutralize binding of the cognate ligand to ICOSL; and/or compete with the cognate ligand for binding to ICOSL; and/or are directed against an interaction site (as defined herein) on ICOSL (such as the ligand binding site);

which amino acid sequences may be as further described herein (and may for example be Nanobodies); as well as polypeptides of the invention that comprise one or more of such amino acid sequences (which may be as further described herein, and may for example be bispecific and/or biparatopic polypeptides as described herein), and nucleic acid sequences that encode such amino acid sequences and polypeptides. Such amino acid sequences and polypeptides do not include any naturally occurring ligands.

Accordingly, some particularly preferred Nanobodies of the invention are Nanobodies which can bind (as further defined herein) to and/or are directed against to ICOSL and which:

i) have at least 80% amino acid identity with at least one of the amino acid sequences of SEQ ID NO's: 505-511, in which for the purposes of determining the degree of amino acid identity, the amino acid residues that form the CDR sequences are disregarded. In this respect, reference is also made to Table A-1e, which lists the framework 1 sequences (SEQ ID NO's: 456-462), framework 2 sequences (SEQ ID NO's: 470-476), framework 3 sequences (SEQ ID NO's: 484-490) and framework 4 sequences (SEQ ID NO's: 498-504) of the Nanobodies of SEQ ID NO's: 505-511 (with respect to the amino acid residues at positions 1 to 4 and 27 to 30 of the framework 1 sequences, reference is also made to the comments made below. Thus, for determining the degree of amino acid identity, these residues are preferably disregarded);

and in which:

ii) preferably one or more of the amino acid residues at positions 11, 37, 44, 45, 47, 83, 84, 103, 104 and 108 according to the Kabat numbering are chosen from the Hallmark residues mentioned in Table A-3 below.

In these Nanobodies, the CDR sequences are generally as further defined herein.

In another preferred aspect of the invention, Nanobodies are raised against CD28. SEQ ID NO's: 554-559 give the amino acid sequences of a number of $V_{HH}$ sequences that have been raised against CD28.

In particular, the invention in some specific aspects provides:

amino acid sequences that are directed against (as defined herein) CD28 and that have at least 80%, preferably at least 85%, such as 90% or 95% or more sequence identity with at least one of the amino acid sequences of SEQ ID NO's: 554-559. These amino acid sequences may further be such that they neutralize binding of the cognate ligand to CD28; and/or compete with the cognate ligand for binding to CD28; and/or are directed against an interaction site (as defined herein) on CD28 (such as the ligand binding site);

amino acid sequences that cross-block (as defined herein) the binding of at least one of the amino acid sequences of SEQ ID NO's: 554-559 to CD28 and/or that compete with at least one of the amino acid sequences of SEQ ID NO's: 554-559 for binding to CD28. Again, these amino acid sequences may further be such that they neutralize binding of the cognate ligand to CD28; and/or compete with the cognate ligand for binding to CD28; and/or are directed against an interaction site (as defined herein) on CD28 (such as the ligand binding site);

which amino acid sequences may be as further described herein (and may for example be Nanobodies); as well as polypeptides of the invention that comprise one or more of such amino acid sequences (which may be as further described herein, and may for example be bispecific and/or biparatopic polypeptides as described herein), and nucleic acid sequences that encode such amino acid sequences and polypeptides. Such amino acid sequences and polypeptides do not include any naturally occurring ligands.

In some other specific aspects, the invention provides:

amino acid sequences of the invention that are specific for (as defined herein) CD28 compared to CTLA4;

which amino acid sequences of the invention may be as further described herein (and may for example be Nanobodies); as well as polypeptides of the invention that comprise one or more of such amino acid sequences (which may be as further described herein, and may for example be bispecific and/or biparatopic polypeptides as described herein), and nucleic acid sequences that encode such amino acid sequences and polypeptides. Such amino acid sequences and polypeptides do not include any naturally occurring ligands.

Accordingly, some particularly preferred Nanobodies of the invention are Nanobodies which can bind (as further defined herein) to and/or are directed against to CD28 and which:

i) have at least 80% amino acid identity with at least one of the amino acid sequences of SEQ ID NO's: 554-559, in which for the purposes of determining the degree of amino acid identity, the amino acid residues that form the CDR sequences are disregarded. In this respect, reference is also made to Table A-1f, which lists the framework 1 sequences (SEQ ID NO's: 512-517), framework 2 sequences (SEQ ID NO's: 524-529), framework 3 sequences (SEQ ID NO's: 536-541) and framework 4 sequences (SEQ ID NO's: 548-553) of the Nanobodies of SEQ ID NO's: 554-559 (with respect to the amino acid residues at positions 1 to 4 and 27 to 30 of the framework 1 sequences, reference is also made to the comments made below. Thus, for determining the degree of amino acid identity, these residues are preferably disregarded);

and in which:

ii) preferably one or more of the amino acid residues at positions 11, 37, 44, 45, 47, 83, 84, 103, 104 and 108 according to the Kabat numbering are chosen from the Hallmark residues mentioned in Table A-3 below.

In these Nanobodies, the CDR sequences are generally as further defined herein.

In another preferred aspect of the invention, Nanobodies are raised against CTLA4. SEQ ID NO's: 1288-1391 give the amino acid sequences of a number of $V_{HH}$ sequences that have been raised against CTLA4.

In particular, the invention in some specific aspects provides:
amino acid sequences that are directed against (as defined herein) CTLA4 and that have at least 80%, preferably at least 85%, such as 90% or 95% or more sequence identity with at least one of the amino acid sequences of SEQ ID NO's: 1288-1391. These amino acid sequences may further be such that they neutralize binding of the cognate ligand to CD28; and/or compete with the cognate ligand for binding to CTLA4; and/or are directed against an interaction site (as defined herein) on CTLA4 (such as the ligand binding site);
amino acid sequences that cross-block (as defined herein) the binding of at least one of the amino acid sequences of SEQ ID NO's: 1288-1391 to CTLA4 and/or that compete with at least one of the amino acid sequences of SEQ ID NO's: 1288-1391 for binding to CTLA4. Again, these amino acid sequences may further be such that they neutralize binding of the cognate ligand to CTLA4; and/or compete with the cognate ligand for binding to CTLA4; and/or are directed against an interaction site (as defined herein) on CD28 (such as the ligand binding site);

which amino acid sequences may be as further described herein (and may for example be Nanobodies); as well as polypeptides of the invention that comprise one or more of such amino acid sequences (which may be as further described herein, and may for example be bispecific and/or biparatopic polypeptides as described herein), and nucleic acid sequences that encode such amino acid sequences and polypeptides. Such amino acid sequences and polypeptides do not include any naturally occurring ligands.

In some other specific aspects, the invention provides:
amino acid sequences of the invention that are specific for (as defined herein) CTLA4 compared to CD28;
which amino acid sequences of the invention may be as further described herein (and may for example be Nanobodies); as well as polypeptides of the invention that comprise one or more of such amino acid sequences (which may be as further described herein, and may for example be bispecific and/or biparatopic polypeptides as described herein), and nucleic acid sequences that encode such amino acid sequences and polypeptides. Such amino acid sequences and polypeptides do not include any naturally occurring ligands.

Accordingly, some particularly preferred Nanobodies of the invention are Nanobodies which can bind (as further defined herein) to and/or are directed against to CTLA4 and which:

i) have at least 80% amino acid identity with at least one of the amino acid sequences of SEQ ID NO's: 1288-1391, in which for the purposes of determining the degree of amino acid identity, the amino acid residues that form the CDR sequences are disregarded. In this respect, reference is also made to Table A-1g, which lists the framework 1 sequences (SEQ ID NO's: 560-663), framework 2 sequences (SEQ ID NO's: 768-871), framework 3 sequences (SEQ ID NO's: 976-1079) and framework 4 sequences (SEQ ID NO's: 1184-1287) of the Nanobodies of SEQ ID NO's: 1288-1391 (with respect to the amino acid residues at positions 1 to 4 and 27 to 30 of the framework 1 sequences, reference is also made to the comments made below. Thus, for determining the degree of amino acid identity, these residues are preferably disregarded);
and in which:
ii) preferably one or more of the amino acid residues at positions 11, 37, 44, 45, 47, 83, 84, 103, 104 and 108 according to the Kabat numbering are chosen from the Hallmark residues mentioned in Table A-3 below.

In these Nanobodies, the CDR sequences are generally as further defined herein.

Again, such Nanobodies may be derived in any suitable manner and from any suitable source, and may for example be naturally occurring $V_{HH}$ sequences (i.e. from a suitable species of Camelid) or synthetic or semi-synthetic amino acid sequences, including but not limited to "humanized" (as defined herein) Nanobodies, "camelized" (as defined herein) immunoglobulin sequences (and in particular camelized heavy chain variable domain sequences), as well as Nanobodies that have been obtained by techniques such as affinity maturation (for example, starting from synthetic, random or naturally occurring immunoglobulin sequences), CDR grafting, veneering, combining fragments derived from different immunoglobulin sequences, PCR assembly using overlapping primers, and similar techniques for engineering immunoglobulin sequences well known to the skilled person; or any suitable combination of any of the foregoing as further described herein. Also, when a Nanobody comprises a $V_{HH}$ sequence, said Nanobody may be suitably humanized, as further described herein, so as to provide one or more further (partially or fully) humanized Nanobodies of the invention. Similarly, when a Nanobody comprises a synthetic or semi-synthetic sequence (such as a partially humanized sequence), said Nanobody may optionally be further suitably humanized, again as described herein, again so as to provide one or more further (partially or fully) humanized Nanobodies of the invention.

In particular, humanized Nanobodies may be amino acid sequences that are as generally defined for Nanobodies in the previous paragraphs, but in which at least one amino acid residue is present (and in particular, in at least one of the framework residues) that is and/or that corresponds to a humanizing substitution (as defined herein). Some preferred, but non-limiting humanizing substitutions (and suitable combinations thereof) will become clear to the skilled person based on the disclosure herein. In addition, or alternatively, other potentially useful humanizing substitutions can be ascertained by comparing the sequence of the framework regions of a naturally occurring $V_{HH}$ sequence with the corresponding framework sequence of one or more closely related human $V_H$ sequences, after which one or more of the potentially useful humanizing substitutions (or combinations thereof) thus determined can be introduced into said $V_{HH}$ sequence (in any manner known per se, as further described herein) and the resulting humanized $V_{HH}$ sequences can be tested for affinity for the target, for stability, for ease and level of expression, and/or for other desired properties. In this way, by means of a limited degree of trial and error, other suitable humanizing substitutions (or suitable combinations thereof) can be determined by the skilled person based on the disclosure herein. Also, based on the foregoing, (the framework regions of) a Nanobody may be partially humanized or fully humanized.

Some particularly preferred humanized Nanobodies of the invention are humanized variants of the Nanobodies of SEQ ID NO's: 266-285.

Thus, some other preferred Nanobodies of the invention are Nanobodies which can bind (as further defined herein) to B7-1 and/or B7-2 and which:
i) are a humanized variant of one of the amino acid sequences of SEQ ID NO's: 266-285; and/or
ii) have at least 80% amino acid identity with at least one of the amino acid sequences of SEQ ID NO's: 266-285, in which for the purposes of determining the degree of amino acid identity, the amino acid residues that form the CDR sequences are disregarded;

and in which:

iii) preferably one or more of the amino acid residues at positions 11, 37, 44, 45, 47, 83, 84, 103, 104 and 108 according to the Kabat numbering are chosen from the Hallmark residues mentioned in Table A-3 below.

Some other particularly preferred humanized Nanobodies of the invention are humanized variants of the Nanobodies of SEQ ID NO's: 347-351.

Thus, some other preferred Nanobodies of the invention are Nanobodies which can bind (as further defined herein) to PD-1 and which:

i) are a humanized variant of one of the amino acid sequences of SEQ ID NO's: 347-351; and/or ii) have at least 80% amino acid identity with at least one of the amino acid sequences of SEQ ID NO's: 347-351, in which for the purposes of determining the degree of amino acid identity, the amino acid residues that form the CDR sequences are disregarded;

and in which:

iii) preferably one or more of the amino acid residues at positions 11, 37, 44, 45, 47, 83, 84, 103, 104 and 108 according to the Kabat numbering are chosen from the Hallmark residues mentioned in Table A-3 below.

Some other particularly preferred humanized Nanobodies of the invention are humanized variants of the Nanobodies of SEQ ID NO's: 394-399.

Thus, some other preferred Nanobodies of the invention are Nanobodies which can bind (as further defined herein) to PD-L1 and which:

i) are a humanized variant of one of the amino acid sequences of SEQ ID NO's: 394-399; and/or ii) have at least 80% amino acid identity with at least one of the amino acid sequences of SEQ ID NO's: 394-399, in which for the purposes of determining the degree of amino acid identity, the amino acid residues that form the CDR sequences are disregarded;

and in which:

iii) preferably one or more of the amino acid residues at positions 11, 37, 44, 45, 47, 83, 84, 103, 104 and 108 according to the Kabat numbering are chosen from the Hallmark residues mentioned in Table A-3 below.

Some other particularly preferred humanized Nanobodies of the invention are humanized variants of the Nanobodies of SEQ ID NO's: 449-455.

Thus, some other preferred Nanobodies of the invention are Nanobodies which can bind (as further defined herein) to PD-L2 and which:

i) are a humanized variant of one of the amino acid sequences of SEQ ID NO's: 449-455; and/or ii) have at least 80% amino acid identity with at least one of the amino acid sequences of SEQ ID NO's: 449-455, in which for the purposes of determining the degree of amino acid identity, the amino acid residues that form the CDR sequences are disregarded;

and in which:

iii) preferably one or more of the amino acid residues at positions 11, 37, 44, 45, 47, 83, 84, 103, 104 and 108 according to the Kabat numbering are chosen from the Hallmark residues mentioned in Table A-3 below.

Some other particularly preferred humanized Nanobodies of the invention are humanized variants of the Nanobodies of SEQ ID NO's: 505-511.

Thus, some other preferred Nanobodies of the invention are Nanobodies which can bind (as further defined herein) to ICOSL and which:

i) are a humanized variant of one of the amino acid sequences of SEQ ID NO's: 505-511; and/or ii) have at least 80% amino acid identity with at least one of the amino acid sequences of SEQ ID NO's: 505-511, in which for the purposes of determining the degree of amino acid identity, the amino acid residues that form the CDR sequences are disregarded;

and in which:

iii) preferably one or more of the amino acid residues at positions 11, 37, 44, 45, 47, 83, 84, 103, 104 and 108 according to the Kabat numbering are chosen from the Hallmark residues mentioned in Table A-3 below.

Some other particularly preferred humanized Nanobodies of the invention are humanized variants of the Nanobodies of SEQ ID NO's: 554-559.

Thus, some other preferred Nanobodies of the invention are Nanobodies which can bind (as further defined herein) to CD28 and which:

i) are a humanized variant of one of the amino acid sequences of SEQ ID NO's: 554-559; and/or ii) have at least 80% amino acid identity with at least one of the amino acid sequences of SEQ ID NO's: 554-559, in which for the purposes of determining the degree of amino acid identity, the amino acid residues that form the CDR sequences are disregarded;

and in which:

iii) preferably one or more of the amino acid residues at positions 11, 37, 44, 45, 47, 83, 84, 103, 104 and 108 according to the Kabat numbering are chosen from the Hallmark residues mentioned in Table A-3 below.

Some other particularly preferred humanized Nanobodies of the invention are humanized variants of the Nanobodies of SEQ ID NO's: 1288-1391, of which the amino acid sequences of SEQ ID NO's: 1407-1418 are some especially preferred examples.

Thus, some other preferred Nanobodies of the invention are Nanobodies which can bind (as further defined herein) to CTLA4 and which:

i) are a humanized variant of one of the amino acid sequences of SEQ ID NO's: 1288-1391; and/or ii) have at least 80% amino acid identity with at least one of the amino acid sequences of SEQ ID NO's: 1288-1391 and/or at least one of the amino acid sequences of SEQ ID NO's: 1407-1418, in which for the purposes of determining the degree of amino acid identity, the amino acid residues that form the CDR sequences are disregarded;

and in which:

iii) preferably one or more of the amino acid residues at positions 11, 37, 44, 45, 47, 83, 84, 103, 104 and 108 according to the Kabat numbering are chosen from the Hallmark residues mentioned in Table A-3 below.

According to another specific aspect of the invention, the invention provides a number of streches of amino acid residues (i.e. small peptides) that are particularly suited for binding to an APC target or a T-cell target. These streches of amino acid residues may be present in, and/or may be corporated into, an amino acid sequence of the invention, in particular in such a way that they form (part of) the antigen binding site of an amino acid sequence of the invention. As these streches of amino acid residues were first generated as CDR sequences of heavy chain antibodies or $V_{HH}$ sequences that were raised against the APC target or T-cell target (or may be based on and/or derived from such CDR sequences, as further described herein), they will also generally be referred to herein as "CDR sequences" (i.e. as CDR1 sequences, CDR2 sequences and CDR3 sequences, respectively). It should however be noted that the invention in its broadest sense is not limited to a specific structural role or function that these streches of amino acid residues may have in an amino acid sequence of the invention, as long as these streches of amino acid residues allow the amino acid sequence of the invention to bind to the APC target or a T-cell target. Thus, generally, the invention in its broadest sense comprises any amino acid sequence that is capable of binding to an APC target or a T-cell target and that comprises one or more CDR sequences as described herein, and in particular a suitable combination of two or more such CDR sequences, that are suitably linked to each other via one or more further amino acid sequences, such that the entire amino acid sequence forms a binding domain and/or binding unit that is capable of binding to an APC target or a T-cell target. It should however also be noted that the presence of only one such CDR sequence in an amino acid sequence of the invention may by itself already be sufficient to provide an amino acid sequence of the invention that is capable of binding to the APC target or T-cell target; reference is for example again made to the so-called "Expedite fragments" described in WO 03/050531.

Thus, in another specific, but non-limiting aspect, the amino acid sequence of the invention may be an amino acid sequence that comprises at least one amino acid sequence that is chosen from the group consisting of the CDR1 sequences, CDR2 sequences and CDR3 sequences that are described herein (or any suitable combination thereof). In particular, an amino acid sequence of the invention may be an amino acid sequence that comprises at least one antigen binding site, wherein said antigen binding site comprises at least one amino acid sequence that is chosen from the group consisting of the CDR1 sequences, CDR2 sequences and CDR3 sequences that are described herein (or any suitable combination thereof).

Generally, in this aspect of the invention, the amino acid sequence of the invention may be any amino acid sequence that comprises at least one stretch of amino acid residues, in which said stretch of amino acid residues has an amino acid sequence that corresponds to the sequence of at least one of the CDR sequences described herein. Such an amino acid sequence may or may not comprise an immunoglobulin fold. For example, and without limitation, such an amino acid sequence may be a suitable fragment of an immunoglobulin sequence that comprises at least one such CDR sequence, but that is not large enough to form a (complete) immunoglobulin fold (reference is for example again made to the "Expedite fragments" described in WO 03/050531). Alternatively, such an amino acid sequence may be a suitable "protein scaffold" that comprises least one stretch of amino acid residues that corresponds to such a CDR sequence (i.e. as part of its antigen binding site). Suitable scaffolds for presenting amino acid sequences will be clear to the skilled person, and for example comprise, without limitation, to binding scaffolds based on or derived from immunoglobulins (i.e. other than the immunoglobulin sequences already described herein), protein scaffolds derived from protein A domains (such as Affibodies™), tendamistat, fibronectin, lipocalin, CTLA-4, T-cell receptors, designed ankyrin repeats, avimers and PDZ domains (Binz et al., Nat. Biotech 2005, Vol 23:1257), and binding moieties based on DNA or RNA including but not limited to DNA or RNA aptamers (Ulrich et al., Comb Chem High Throughput Screen 2006 9(8):619-32).

Again, any amino acid sequence of the invention that comprises one or more of these CDR sequences is preferably such that it can specifically bind (as defined herein) to an APC target or a T-cell target, and more in particular such that it can bind to an APC target or a T-cell target with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein), that is as defined herein.

More in particular, the amino acid sequences according to this aspect of the invention may be any amino acid sequence that comprises at least one antigen binding site, wherein said antigen binding site comprises at least two amino acid sequences that are chosen from the group consisting of the CDR1 sequences described herein, the CDR2 sequences described herein and the CDR3 sequences described herein, such that (i) when the first amino acid sequence is chosen from the CDR1 sequences described herein, the second amino acid sequence is chosen from the CDR2 sequences described herein or the CDR3 sequences described herein; (ii) when the first amino acid sequence is chosen from the CDR2 sequences described herein, the second amino acid sequence is chosen from the CDR1 sequences described herein or the CDR3 sequences described herein; or (iii) when the first amino acid sequence is chosen from the CDR3 sequences described herein, the second amino acid sequence is chosen from the CDR1 sequences described herein or the CDR3 sequences described herein.

Even more in particular, the amino acid sequences of the invention may be amino acid sequences that comprise at least one antigen binding site, wherein said antigen binding site comprises at least three amino acid sequences that are chosen from the group consisting of the CDR1 sequences described herein, the CDR2 sequences described herein and the CDR3 sequences described herein, such that the first amino acid sequence is chosen from the CDR1 sequences described herein, the second amino acid sequence is chosen from the CDR2 sequences described herein, and the third amino acid sequence is chosen from the CDR3 sequences described herein. Preferred combinations of CDR1, CDR2 and CDR3 sequences will become clear from the further description herein. As will be clear to the skilled person, such an amino acid sequence is preferably an immunoglobulin sequence (as further described herein), but it may for example also be any other amino acid sequence that comprises a suitable scaffold for presenting said CDR sequences.

Thus, in one specific, but non-limiting aspect, the invention relates to an amino acid sequence directed against B7-1 and/or B7-2, that comprises one or more stretches of amino acid residues chosen from the group consisting of:

a) the amino acid sequences of SEQ ID NO's: 146-165;
b) amino acid sequences that have at least 80% amino acid identity with at least one of the amino acid sequences of SEQ ID NO's: 146-165;
c) amino acid sequences that have 3, 2, or 1 amino acid difference with at least one of the amino acid sequences of SEQ ID NO's: 146-165;
d) the amino acid sequences of SEQ ID NO's: 186-205;
e) amino acid sequences that have at least 80% amino acid identity with at least one of the amino acid sequences of SEQ ID NO's: 186-205;
f) amino acid sequences that have 3, 2, or 1 amino acid difference with at least one of the amino acid sequences of SEQ ID NO's: 186-205;
g) the amino acid sequences of SEQ ID NO's: 226-245;
h) amino acid sequences that have at least 80% amino acid identity with at least one of the amino acid sequences of SEQ ID NO's: 226-245;

i) amino acid sequences that have 3, 2, or 1 amino acid difference with at least one of the amino acid sequences of SEQ ID NO's: 226-245;
or any suitable combination thereof.

When an amino acid sequence of the invention contains one or more amino acid sequences according to b) and/or c):
i) any amino acid substitution in such an amino acid sequence according to b) and/or c) is preferably, and compared to the corresponding amino acid sequence according to a), a conservative amino acid substitution, (as defined herein);
and/or
ii) the amino acid sequence according to b) and/or c) preferably only contains amino acid substitutions, and no amino acid deletions or insertions, compared to the corresponding amino acid sequence according to a);
and/or
iii) the amino acid sequence according to b) and/or c) may be an amino acid sequence that is derived from an amino acid sequence according to a) by means of affinity maturation using one or more techniques of affinity maturation known per se.

Similarly, when an amino acid sequence of the invention contains one or more amino acid sequences according to e) and/or f):
i) any amino acid substitution in such an amino acid sequence according to e) and/or f) is preferably, and compared to the corresponding amino acid sequence according to d), a conservative amino acid substitution, (as defined herein);
and/or
ii) the amino acid sequence according to e) and/or f) preferably only contains amino acid substitutions, and no amino acid deletions or insertions, compared to the corresponding amino acid sequence according to d);
and/or
iii) the amino acid sequence according to e) and/or f) may be an amino acid sequence that is derived from an amino acid sequence according to d) by means of affinity maturation using one or more techniques of affinity maturation known per se.

Also, similarly, when an amino acid sequence of the invention contains one or more amino acid sequences according to h) and/or i):
i) any amino acid substitution in such an amino acid sequence according to h) and/or i) is preferably, and compared to the corresponding amino acid sequence according to g), a conservative amino acid substitution, (as defined herein);
and/or
ii) the amino acid sequence according to h) and/or i) preferably only contains amino acid substitutions, and no amino acid deletions or insertions, compared to the corresponding amino acid sequence according to g);
and/or
iii) the amino acid sequence according to h) and/or i) may be an amino acid sequence that is derived from an amino acid sequence according to g) by means of affinity maturation using one or more techniques of affinity maturation known per se.

It should be understood that the last preceding paragraphs also generally apply to any amino acid sequences of the invention that comprise one or more amino acid sequences according to b), c), e), f), h) or i), respectively.

In this specific aspect, the amino acid sequence preferably comprises one or more stretches of amino acid residues chosen from the group consisting of:
i) the amino acid sequences of SEQ ID NO's: 146-165;
ii) the amino acid sequences of SEQ ID NO's: 186-205; and
iii) the amino acid sequences of SEQ ID NO's: 226-245;
or any suitable combination thereof.

Also, preferably, in such an amino acid sequence, at least one of said stretches of amino acid residues forms part of the antigen binding site for binding against B7-1 and/or B7-2.

In a more specific, but again non-limiting aspect, the invention relates to an amino acid sequence directed against B7-1 and/or B7-2, that comprises two or more stretches of amino acid residues chosen from the group consisting of:
a) the amino acid sequences of SEQ ID NO's: 146-165;
b) amino acid sequences that have at least 80% amino acid identity with at least one of the amino acid sequences of SEQ ID NO's: 146-165;
c) amino acid sequences that have 3, 2, or 1 amino acid difference with at least one of the amino acid sequences of SEQ ID NO's: 146-165;
d) the amino acid sequences of SEQ ID NO's: 186-205;
e) amino acid sequences that have at least 80% amino acid identity with at least one of the amino acid sequences of SEQ ID NO's: 186-205;
f) amino acid sequences that have 3, 2, or 1 amino acid difference with at least one of the amino acid sequences of SEQ ID NO's: 186-205;
g) the amino acid sequences of SEQ ID NO's: 226-245;
h) amino acid sequences that have at least 80% amino acid identity with at least one of the amino acid sequences of SEQ ID NO's: 226-245;
i) amino acid sequences that have 3, 2, or 1 amino acid difference with at least one of the amino acid sequences of SEQ ID NO's: 226-245;
such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

In this specific aspect, the amino acid sequence preferably comprises two or more stretches of amino acid residues chosen from the group consisting of:
i) the amino acid sequences of SEQ ID NO's: 146-165;
ii) the amino acid sequences of SEQ ID NO's: 186-205; and
iii) the amino acid sequences of SEQ ID NO's: 226-245;
such that, (i) when the first stretch of amino acid residues corresponds to one of the amino acid sequences of SEQ ID NO's: 146-165, the second stretch of amino acid residues corresponds to one of the amino acid sequences of SEQ ID NO's: 186-205 or of SEQ ID NO's: 226-245; (ii) when the first stretch of amino acid residues corresponds to one of the amino acid sequences of SEQ ID NO's: 186-205, the second stretch of amino acid residues corresponds to one of the amino acid sequences of SEQ ID NO's: 146-165 or of SEQ ID NO's: 226-245; or (iii) when the first stretch of amino acid residues corresponds to one of the amino acid sequences of SEQ ID NO's: 226-245, the second stretch of amino acid residues corresponds to one of the amino acid sequences of SEQ ID NO's: 146-165 or of SEQ ID NO's: 186-205.

Also, in such an amino acid sequence, the at least two stretches of amino acid residues again preferably form part of the antigen binding site for binding against B7-1 and/or B7-2.

In an even more specific, but non-limiting aspect, the invention relates to an amino acid sequence directed against B7-1 and/or B7-2, that comprises three or more stretches of amino acid residues, in which the first stretch of amino acid residues is chosen from the group consisting of:
a) the amino acid sequences of SEQ ID NO's: 146-165;
b) amino acid sequences that have at least 80% amino acid identity with at least one of the amino acid sequences of SEQ ID NO's: 146-165;
c) amino acid sequences that have 3, 2, or 1 amino acid difference with at least one of the amino acid sequences of SEQ ID NO's: 146-165;
the second stretch of amino acid residues is chosen from the group consisting of:
d) the amino acid sequences of SEQ ID NO's: 186-205;
e) amino acid sequences that have at least 80% amino acid identity with at least one of the amino acid sequences of SEQ ID NO's: 186-205;
f) amino acid sequences that have 3, 2, or 1 amino acid difference with at least one of the amino acid sequences of SEQ ID NO's: 186-205;
and the third stretch of amino acid residues is chosen from the group consisting of:
g) the amino acid sequences of SEQ ID NO's: 226-245;
h) amino acid sequences that have at least 80% amino acid identity with at least one of the amino acid sequences of SEQ ID NO's: 226-245;
i) amino acid sequences that have 3, 2, or 1 amino acid difference with at least one of the amino acid sequences of SEQ ID NO's: 226-245.

Preferably, in this specific aspect, the first stretch of amino acid residues is chosen from the group consisting of the amino acid sequences of SEQ ID NO's: 146-165; the second stretch of amino acid residues is chosen from the group consisting of the amino acid sequences of SEQ ID NO's: 186-205; and the third stretch of amino acid residues is chosen from the group consisting of the amino acid sequences of SEQ ID NO's: 226-245.

Again, preferably, in such an amino acid sequence, the at least three stretches of amino acid residues forms part of the antigen binding site for binding against B7-1 and/or B7-2.

Preferred combinations of such stretches of amino acid sequences will become clear from the further disclosure herein.

Preferably, in such amino acid sequences the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 266-285. This degree of amino acid identity can for example be determined by determining the degree of amino acid identity (in a manner described herein) between said amino acid sequence and one or more of the sequences of SEQ ID NO's: 266-285, in which the amino acid residues that form the framework regions are disregarded. Also, such amino acid sequences of the invention can be as further described herein.

Also, such amino acid sequences are preferably such that they can specifically bind (as defined herein) to B7-1 and/or B7-2; and more in particular bind to B7-1 and/or B7-2 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

When the amino acid sequence of the invention essentially consists of 4 framework regions (FR1 to FR4, respectively) and 3 complementarity determining regions (CDR1 to CDR3, respectively), the amino acid sequence of the invention is preferably such that:
CDR1 is chosen from the group consisting of:
a) the amino acid sequences of SEQ ID NO's: 146-165;
b) amino acid sequences that have at least 80% amino acid identity with at least one of the amino acid sequences of SEQ ID NO's: 146-165;
c) amino acid sequences that have 3, 2, or 1 amino acid difference with at least one of the amino acid sequences of SEQ ID NO's: 146-165;
and/or
CDR2 is chosen from the group consisting of:
d) the amino acid sequences of SEQ ID NO's: 186-205;
e) amino acid sequences that have at least 80% amino acid identity with at least one of the amino acid sequences of SEQ ID NO's: 186-205;
f) amino acid sequences that have 3, 2, or 1 amino acid difference with at least one of the amino acid sequences of SEQ ID NO's: 186-205;
and/or
CDR3 is chosen from the group consisting of:
g) the amino acid sequences of SEQ ID NO's: 226-245;
h) amino acid sequences that have at least 80% amino acid identity with at least one of the amino acid sequences of SEQ ID NO's: 226-245;
i) amino acid sequences that have 3, 2, or 1 amino acid difference with at least one of the amino acid sequences of SEQ ID NO's: 226-245.

In particular, such an amino acid sequence of the invention may be such that CDR1 is chosen from the group consisting of the amino acid sequences of SEQ ID NO's: 146-165; and/or CDR2 is chosen from the group consisting of the amino acid sequences of SEQ ID NO's: 186-205; and/or CDR3 is chosen from the group consisting of the amino acid sequences of SEQ ID NO's: 226-245.

In particular, when the amino acid sequence of the invention essentially consists of 4 framework regions (FR1 to FR4, respectively) and 3 complementarity determining regions (CDR1 to CDR3, respectively), the amino acid sequence of the invention is preferably such that:
CDR1 is chosen from the group consisting of:
a) the amino acid sequences of SEQ ID NO's: 146-165;
b) amino acid sequences that have at least 80% amino acid identity with at least one of the amino acid sequences of SEQ ID NO's: 146-165;
c) amino acid sequences that have 3, 2, or 1 amino acid difference with at least one of the amino acid sequences of SEQ ID NO's: 146-165;
and
CDR2 is chosen from the group consisting of:
d) the amino acid sequences of SEQ ID NO's: 186-205;
e) amino acid sequences that have at least 80% amino acid identity with at least one of the amino acid sequences of SEQ ID NO's: 186-205;
f) amino acid sequences that have 3, 2, or 1 amino acid difference with at least one of the amino acid sequences of SEQ ID NO's: 186-205;
and
CDR3 is chosen from the group consisting of:
g) the amino acid sequences of SEQ ID NO's: 226-245;
h) amino acid sequences that have at least 80% amino acid identity with at least one of the amino acid sequences of SEQ ID NO's: 226-245;

i) amino acid sequences that have 3, 2, or 1 amino acid difference with at least one of the amino acid sequences of SEQ ID NO's: 226-245; or any suitable fragment of such an amino acid sequence In particular, such an amino acid sequence of the invention may be such that CDR1 is chosen from the group consisting of the amino acid sequences of SEQ ID NO's: 146-165; and CDR2 is chosen from the group consisting of the amino acid sequences of SEQ ID NO's: 186-205; and CDR3 is chosen from the group consisting of the amino acid sequences of SEQ ID NO's: 226-245.

Again, preferred combinations of CDR sequences will become clear from the further description herein.

Also, such amino acid sequences are preferably such that they can specifically bind (as defined herein) to B7-1 and/or B7-2; and more in particular bind to B7-1 and/or B7-2 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In one preferred, but non-limiting aspect, the invention relates to an amino acid sequence that essentially consists of 4 framework regions (FR1 to FR4, respectively) and 3 complementarity determining regions (CDR1 to CDR3, respectively), in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 266-285. This degree of amino acid identity can for example be determined by determining the degree of amino acid identity (in a manner described herein) between said amino acid sequence and one or more of the sequences of SEQ ID NO's: 266-285, in which the amino acid residues that form the framework regions are disregarded. Such amino acid sequences of the invention can be as further described herein.

In another specific, but non-limiting aspect, the invention relates to an amino acid sequence directed against PD-1, that comprises one or more stretches of amino acid residues chosen from the group consisting of:
a) the amino acid sequences of SEQ ID NO's: 317-321;
b) amino acid sequences that have at least 80% amino acid identity with at least one of the amino acid sequences of SEQ ID NO's: 317-321;
c) amino acid sequences that have 3, 2, or 1 amino acid difference with at least one of the amino acid sequences of SEQ ID NO's: 317-321;
d) the amino acid sequences of SEQ ID NO's: 327-331;
e) amino acid sequences that have at least 80% amino acid identity with at least one of the amino acid sequences of SEQ ID NO's: 327-331;
f) amino acid sequences that have 3, 2, or 1 amino acid difference with at least one of the amino acid sequences of SEQ ID NO's: 327-331;
g) the amino acid sequences of SEQ ID NO's: 337-341;
h) amino acid sequences that have at least 80% amino acid identity with at least one of the amino acid sequences of SEQ ID NO's: 337-341;
i) amino acid sequences that have 3, 2, or 1 amino acid difference with at least one of the amino acid sequences of SEQ ID NO's: 337-341;
or any suitable combination thereof.

When an amino acid sequence of the invention contains one or more amino acid sequences according to b) and/or c):
i) any amino acid substitution in such an amino acid sequence according to b) and/or c) is preferably, and compared to the corresponding amino acid sequence according to a), a conservative amino acid substitution, (as defined herein);
and/or
ii) the amino acid sequence according to b) and/or c) preferably only contains amino acid substitutions, and no amino acid deletions or insertions, compared to the corresponding amino acid sequence according to a);
and/or
iii) the amino acid sequence according to b) and/or c) may be an amino acid sequence that is derived from an amino acid sequence according to a) by means of affinity maturation using one or more techniques of affinity maturation known per se.

Similarly, when an amino acid sequence of the invention contains one or more amino acid sequences according to e) and/or f):
i) any amino acid substitution in such an amino acid sequence according to e) and/or f) is preferably, and compared to the corresponding amino acid sequence according to d), a conservative amino acid substitution, (as defined herein);
and/or
ii) the amino acid sequence according to e) and/or f) preferably only contains amino acid substitutions, and no amino acid deletions or insertions, compared to the corresponding amino acid sequence according to d);
and/or
iii) the amino acid sequence according to e) and/or f) may be an amino acid sequence that is derived from an amino acid sequence according to d) by means of affinity maturation using one or more techniques of affinity maturation known per se.

Also, similarly, when an amino acid sequence of the invention contains one or more amino acid sequences according to h) and/or i):
i) any amino acid substitution in such an amino acid sequence according to h) and/or i) is preferably, and compared to the corresponding amino acid sequence according to g), a conservative amino acid substitution, (as defined herein);
and/or
ii) the amino acid sequence according to h) and/or i) preferably only contains amino acid substitutions, and no amino acid deletions or insertions, compared to the corresponding amino acid sequence according to g);
and/or
iii) the amino acid sequence according to h) and/or i) may be an amino acid sequence that is derived from an amino acid sequence according to g) by means of affinity maturation using one or more techniques of affinity maturation known per se.

It should be understood that the last preceding paragraphs also generally apply to any amino acid sequences of the invention that comprise one or more amino acid sequences according to b), c), e), f), h) or i), respectively.

In this specific aspect, the amino acid sequence preferably comprises one or more stretches of amino acid residues chosen from the group consisting of:
i) the amino acid sequences of SEQ ID NO's: 317-321;
ii) the amino acid sequences of SEQ ID NO's: 327-331; and
iii) the amino acid sequences of SEQ ID NO's: 337-341;
or any suitable combination thereof.

Also, preferably, in such an amino acid sequence, at least one of said stretches of amino acid residues forms part of the antigen binding site for binding against PD-1.

In a more specific, but again non-limiting aspect, the invention relates to an amino acid sequence directed against PD-1, that comprises two or more stretches of amino acid residues chosen from the group consisting of:

a) the amino acid sequences of SEQ ID NO's: 317-321;
b) amino acid sequences that have at least 80% amino acid identity with at least one of the amino acid sequences of SEQ ID NO's: 317-321;
c) amino acid sequences that have 3, 2, or 1 amino acid difference with at least one of the amino acid sequences of SEQ ID NO's: 317-321;
d) the amino acid sequences of SEQ ID NO's: 327-331;
e) amino acid sequences that have at least 80% amino acid identity with at least one of the amino acid sequences of SEQ ID NO's: 327-331;
f) amino acid sequences that have 3, 2, or 1 amino acid difference with at least one of the amino acid sequences of SEQ ID NO's: 327-331;
g) the amino acid sequences of SEQ ID NO's: 337-341;
h) amino acid sequences that have at least 80% amino acid identity with at least one of the amino acid sequences of SEQ ID NO's: 337-341;
i) amino acid sequences that have 3, 2, or 1 amino acid difference with at least one of the amino acid sequences of SEQ ID NO's: 337-341;
such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

In this specific aspect, the amino acid sequence preferably comprises two or more stretches of amino acid residues chosen from the group consisting of:
i) the amino acid sequences of SEQ ID NO's: 317-321;
ii) the amino acid sequences of SEQ ID NO's: 327-331; and
iii) the amino acid sequences of SEQ ID NO's: 337-341;
such that, (i) when the first stretch of amino acid residues corresponds to one of the amino acid sequences of SEQ ID NO's: 317-321, the second stretch of amino acid residues corresponds to one of the amino acid sequences of SEQ ID NO's: 327-331 or of SEQ ID NO's: 337-341; (ii) when the first stretch of amino acid residues corresponds to one of the amino acid sequences of SEQ ID NO's: 327-331, the second stretch of amino acid residues corresponds to one of the amino acid sequences of SEQ ID NO's: 317-321 or of SEQ ID NO's: 337-341; or (iii) when the first stretch of amino acid residues corresponds to one of the amino acid sequences of SEQ ID NO's: 337-341, the second stretch of amino acid residues corresponds to one of the amino acid sequences of SEQ ID NO's: 317-321 or of SEQ ID NO's: 327-331.

Also, in such an amino acid sequence, the at least two stretches of amino acid residues again preferably form part of the antigen binding site for binding against PD-1.

In an even more specific, but non-limiting aspect, the invention relates to an amino acid sequence directed against PD-1, that comprises three or more stretches of amino acid residues, in which the first stretch of amino acid residues is chosen from the group consisting of:
a) the amino acid sequences of SEQ ID NO's: 317-321;
b) amino acid sequences that have at least 80% amino acid identity with at least one of the amino acid sequences of SEQ ID NO's: 317-321;
c) amino acid sequences that have 3, 2, or 1 amino acid difference with at least one of the amino acid sequences of SEQ ID NO's: 317-321;
the second stretch of amino acid residues is chosen from the group consisting of:
d) the amino acid sequences of SEQ ID NO's: 327-331;
e) amino acid sequences that have at least 80% amino acid identity with at least one of the amino acid sequences of SEQ ID NO's: 327-331;
f) amino acid sequences that have 3, 2, or 1 amino acid difference with at least one of the amino acid sequences of SEQ ID NO's: 327-331;
and the third stretch of amino acid residues is chosen from the group consisting of:
g) the amino acid sequences of SEQ ID NO's: 337-341;
h) amino acid sequences that have at least 80% amino acid identity with at least one of the amino acid sequences of SEQ ID NO's: 337-341;
i) amino acid sequences that have 3, 2, or 1 amino acid difference with at least one of the amino acid sequences of SEQ ID NO's: 337-341.

Preferably, in this specific aspect, the first stretch of amino acid residues is chosen from the group consisting of the amino acid sequences of SEQ ID NO's: 317-321; the second stretch of amino acid residues is chosen from the group consisting of the amino acid sequences of SEQ ID NO's: 327-331; and the third stretch of amino acid residues is chosen from the group consisting of the amino acid sequences of SEQ ID NO's: 337-341.

Again, preferably, in such an amino acid sequence, the at least three stretches of amino acid residues forms part of the antigen binding site for binding against PD-1.

Preferred combinations of such stretches of amino acid sequences will become clear from the further disclosure herein.

Preferably, in such amino acid sequences the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 347-351. This degree of amino acid identity can for example be determined by determining the degree of amino acid identity (in a manner described herein) between said amino acid sequence and one or more of the sequences of SEQ ID NO's: 347-351, in which the amino acid residues that form the framework regions are disregarded. Also, such amino acid sequences of the invention can be as further described herein.

Also, such amino acid sequences are preferably such that they can specifically bind (as defined herein) to PD-1; and more in particular bind to PD-1 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

When the amino acid sequence of the invention essentially consists of 4 framework regions (FR1 to FR4, respectively) and 3 complementarity determining regions (CDR1 to CDR3, respectively), the amino acid sequence of the invention is preferably such that:
CDR1 is chosen from the group consisting of:
a) the amino acid sequences of SEQ ID NO's: 317-321;
b) amino acid sequences that have at least 80% amino acid identity with at least one of the amino acid sequences of SEQ ID NO's: 317-321;

c) amino acid sequences that have 3, 2, or 1 amino acid difference with at least one of the amino acid sequences of SEQ ID NO's: 317-321;
and/or
CDR2 is chosen from the group consisting of:
d) the amino acid sequences of SEQ ID NO's: 327-331;
e) amino acid sequences that have at least 80% amino acid identity with at least one of the amino acid sequences of SEQ ID NO's: 327-331;
f) amino acid sequences that have 3, 2, or 1 amino acid difference with at least one of the amino acid sequences of SEQ ID NO's: 327-331;
and/or
CDR3 is chosen from the group consisting of:
g) the amino acid sequences of SEQ ID NO's: 337-341;
h) amino acid sequences that have at least 80% amino acid identity with at least one of the amino acid sequences of SEQ ID NO's: 337-341;
i) amino acid sequences that have 3, 2, or 1 amino acid difference with at least one of the amino acid sequences of SEQ ID NO's: 337-341.

In particular, such an amino acid sequence of the invention may be such that CDR1 is chosen from the group consisting of the amino acid sequences of SEQ ID NO's: 317-321; and/or CDR2 is chosen from the group consisting of the amino acid sequences of SEQ ID NO's: 327-331; and/or CDR3 is chosen from the group consisting of the amino acid sequences of SEQ ID NO's: 337-341.

In particular, when the amino acid sequence of the invention essentially consists of 4 framework regions (FR1 to FR4, respectively) and 3 complementarity determining regions (CDR1 to CDR3, respectively), the amino acid sequence of the invention is preferably such that:
CDR1 is chosen from the group consisting of:
a) the amino acid sequences of SEQ ID NO's: 317-321;
b) amino acid sequences that have at least 80% amino acid identity with at least one of the amino acid sequences of SEQ ID NO's: 317-321;
c) amino acid sequences that have 3, 2, or 1 amino acid difference with at least one of the amino acid sequences of SEQ ID NO's: 317-321;
and
CDR2 is chosen from the group consisting of:
d) the amino acid sequences of SEQ ID NO's: 327-331;
e) amino acid sequences that have at least 80% amino acid identity with at least one of the amino acid sequences of SEQ ID NO's: 327-331;
f) amino acid sequences that have 3, 2, or 1 amino acid difference with at least one of the amino acid sequences of SEQ ID NO's: 327-331;
and
CDR3 is chosen from the group consisting of:
g) the amino acid sequences of SEQ ID NO's: 337-341;
h) amino acid sequences that have at least 80% amino acid identity with at least one of the amino acid sequences of SEQ ID NO's: 337-341;
i) amino acid sequences that have 3, 2, or 1 amino acid difference with at least one of the amino acid sequences of SEQ ID NO's: 337-341; or any suitable fragment of such an amino acid sequence In particular, such an amino acid sequence of the invention may be such that CDR1 is chosen from the group consisting of the amino acid sequences of SEQ ID NO's: 317-321; and CDR2 is chosen from the group consisting of the amino acid sequences of SEQ ID NO's: 327-331; and CDR3 is chosen from the group consisting of the amino acid sequences of SEQ ID NO's: 337-341.

Again, preferred combinations of CDR sequences will become clear from the further description herein.

Also, such amino acid sequences are preferably such that they can specifically bind (as defined herein) to PD-1; and more in particular bind to PD-1 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In one preferred, but non-limiting aspect, the invention relates to an amino acid sequence that essentially consists of 4 framework regions (FR1 to FR4, respectively) and 3 complementarity determining regions (CDR1 to CDR3, respectively), in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 374-351. This degree of amino acid identity can for example be determined by determining the degree of amino acid identity (in a manner described herein) between said amino acid sequence and one or more of the sequences of SEQ ID NO's: 347-351, in which the amino acid residues that form the framework regions are disregarded. Such amino acid sequences of the invention can be as further described herein.

In another specific, but non-limiting aspect, the invention relates to an amino acid sequence directed against PD-L1, that comprises one or more stretches of amino acid residues chosen from the group consisting of:
a) the amino acid sequences of SEQ ID NO's: 358-363;
b) amino acid sequences that have at least 80% amino acid identity with at least one of the amino acid sequences of SEQ ID NO's: 358-363;
c) amino acid sequences that have 3, 2, or 1 amino acid difference with at least one of the amino acid sequences of SEQ ID NO's: 358-363;
d) the amino acid sequences of SEQ ID NO's: 370-375;
e) amino acid sequences that have at least 80% amino acid identity with at least one of the amino acid sequences of SEQ ID NO's: 370-375;
f) amino acid sequences that have 3, 2, or 1 amino acid difference with at least one of the amino acid sequences of SEQ ID NO's: 370-375;
g) the amino acid sequences of SEQ ID NO's: 382-387;
h) amino acid sequences that have at least 80% amino acid identity with at least one of the amino acid sequences of SEQ ID NO's: 382-387;
i) amino acid sequences that have 3, 2, or 1 amino acid difference with at least one of the amino acid sequences of SEQ ID NO's: 382-387;
or any suitable combination thereof.

When an amino acid sequence of the invention contains one or more amino acid sequences according to b) and/or c):
i) any amino acid substitution in such an amino acid sequence according to b) and/or c) is preferably, and compared to the corresponding amino acid sequence according to a), a conservative amino acid substitution, (as defined herein);
and/or
ii) the amino acid sequence according to b) and/or c) preferably only contains amino acid substitutions, and no amino acid deletions or insertions, compared to the corresponding amino acid sequence according to a);
and/or
iii) the amino acid sequence according to b) and/or c) may be an amino acid sequence that is derived from an amino acid sequence according to a) by means of affinity maturation using one or more techniques of affinity maturation known per se.

Similarly, when an amino acid sequence of the invention contains one or more amino acid sequences according to e) and/or f):
i) any amino acid substitution in such an amino acid sequence according to e) and/or f) is preferably, and compared to the corresponding amino acid sequence according to d), a conservative amino acid substitution, (as defined herein);
and/or
ii) the amino acid sequence according to e) and/or f) preferably only contains amino acid substitutions, and no amino acid deletions or insertions, compared to the corresponding amino acid sequence according to d);
and/or
iii) the amino acid sequence according to e) and/or f) may be an amino acid sequence that is derived from an amino acid sequence according to d) by means of affinity maturation using one or more techniques of affinity maturation known per se.

Also, similarly, when an amino acid sequence of the invention contains one or more amino acid sequences according to h) and/or i):
i) any amino acid substitution in such an amino acid sequence according to h) and/or i) is preferably, and compared to the corresponding amino acid sequence according to g), a conservative amino acid substitution, (as defined herein);
and/or
ii) the amino acid sequence according to h) and/or i) preferably only contains amino acid substitutions, and no amino acid deletions or insertions, compared to the corresponding amino acid sequence according to g);
and/or
iii) the amino acid sequence according to h) and/or i) may be an amino acid sequence that is derived from an amino acid sequence according to g) by means of affinity maturation using one or more techniques of affinity maturation known per se.

It should be understood that the last preceding paragraphs also generally apply to any amino acid sequences of the invention that comprise one or more amino acid sequences according to b), c), e), f), h) or i), respectively.

In this specific aspect, the amino acid sequence preferably comprises one or more stretches of amino acid residues chosen from the group consisting of:
i) the amino acid sequences of SEQ ID NO's: 358-363;
ii) the amino acid sequences of SEQ ID NO's: 370-375; and
iii) the amino acid sequences of SEQ ID NO's: 382-387;
or any suitable combination thereof.

Also, preferably, in such an amino acid sequence, at least one of said stretches of amino acid residues forms part of the antigen binding site for binding against PD-L1.

In a more specific, but again non-limiting aspect, the invention relates to an amino acid sequence directed against PD-L1, that comprises two or more stretches of amino acid residues chosen from the group consisting of:
a) the amino acid sequences of SEQ ID NO's: 358-363;
b) amino acid sequences that have at least 80% amino acid identity with at least one of the amino acid sequences of SEQ ID NO's: 358-363;
c) amino acid sequences that have 3, 2, or 1 amino acid difference with at least one of the amino acid sequences of SEQ ID NO's: 358-363;
d) the amino acid sequences of SEQ ID NO's: 370-375;
e) amino acid sequences that have at least 80% amino acid identity with at least one of the amino acid sequences of SEQ ID NO's: 370-375;
f) amino acid sequences that have 3, 2, or 1 amino acid difference with at least one of the amino acid sequences of SEQ ID NO's: 370-375;
g) the amino acid sequences of SEQ ID NO's: 382-387;
h) amino acid sequences that have at least 80% amino acid identity with at least one of the amino acid sequences of SEQ ID NO's: 382-387;
i) amino acid sequences that have 3, 2, or 1 amino acid difference with at least one of the amino acid sequences of SEQ ID NO's: 382-387;
such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

In this specific aspect, the amino acid sequence preferably comprises two or more stretches of amino acid residues chosen from the group consisting of:
i) the amino acid sequences of SEQ ID NO's: 358-363;
ii) the amino acid sequences of SEQ ID NO's: 370-375; and
iii) the amino acid sequences of SEQ ID NO's: 382-387;
such that, (i) when the first stretch of amino acid residues corresponds to one of the amino acid sequences of SEQ ID NO's: 358-363, the second stretch of amino acid residues corresponds to one of the amino acid sequences of SEQ ID NO's: 370-375 or of SEQ ID NO's: 382-387; (ii) when the first stretch of amino acid residues corresponds to one of the amino acid sequences of SEQ ID NO's: 370-375, the second stretch of amino acid residues corresponds to one of the amino acid sequences of SEQ ID NO's: 358-363 or of SEQ ID NO's: 382-387; or (iii) when the first stretch of amino acid residues corresponds to one of the amino acid sequences of SEQ ID NO's: 382-387, the second stretch of amino acid residues corresponds to one of the amino acid sequences of SEQ ID NO's: 358-363 or of SEQ ID NO's: 370-375.

Also, in such an amino acid sequence, the at least two stretches of amino acid residues again preferably form part of the antigen binding site for binding against PD-L1.

In an even more specific, but non-limiting aspect, the invention relates to an amino acid sequence directed against PD-L1, that comprises three or more stretches of amino acid residues, in which the first stretch of amino acid residues is chosen from the group consisting of:
a) the amino acid sequences of SEQ ID NO's: 358-363;
b) amino acid sequences that have at least 80% amino acid identity with at least one of the amino acid sequences of SEQ ID NO's: 358-363;
c) amino acid sequences that have 3, 2, or 1 amino acid difference with at least one of the amino acid sequences of SEQ ID NO's: 358-363;
the second stretch of amino acid residues is chosen from the group consisting of:
d) the amino acid sequences of SEQ ID NO's: 370-375;
e) amino acid sequences that have at least 80% amino acid identity with at least one of the amino acid sequences of SEQ ID NO's: 370-375;

f) amino acid sequences that have 3, 2, or 1 amino acid difference with at least one of the amino acid sequences of SEQ ID NO's: 370-375;

and the third stretch of amino acid residues is chosen from the group consisting of:

g) the amino acid sequences of SEQ ID NO's: 382-387;

h) amino acid sequences that have at least 80% amino acid identity with at least one of the amino acid sequences of SEQ ID NO's: 382-387;

i) amino acid sequences that have 3, 2, or 1 amino acid difference with at least one of the amino acid sequences of SEQ ID NO's: 382-387.

Preferably, in this specific aspect, the first stretch of amino acid residues is chosen from the group consisting of the amino acid sequences of SEQ ID NO's: 358-363; the second stretch of amino acid residues is chosen from the group consisting of the amino acid sequences of SEQ ID NO's: 370-375; and the third stretch of amino acid residues is chosen from the group consisting of the amino acid sequences of SEQ ID NO's: 382-387.

Again, preferably, in such an amino acid sequence, the at least three stretches of amino acid residues forms part of the antigen binding site for binding against PD-L1.

Preferred combinations of such stretches of amino acid sequences will become clear from the further disclosure herein.

Preferably, in such amino acid sequences the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 394-399. This degree of amino acid identity can for example be determined by determining the degree of amino acid identity (in a manner described herein) between said amino acid sequence and one or more of the sequences of SEQ ID NO's: 394-399, in which the amino acid residues that form the framework regions are disregarded. Also, such amino acid sequences of the invention can be as further described herein.

Also, such amino acid sequences are preferably such that they can specifically bind (as defined herein) to PD-L1; and more in particular bind to PD-L1 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

When the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:

a) the amino acid sequences of SEQ ID NO's: 358-363;

b) amino acid sequences that have at least 80% amino acid identity with at least one of the amino acid sequences of SEQ ID NO's: 358-363;

c) amino acid sequences that have 3, 2, or 1 amino acid difference with at least one of the amino acid sequences of SEQ ID NO's: 358-363;

and/or

CDR2 is chosen from the group consisting of:

d) the amino acid sequences of SEQ ID NO's: 370-375;

e) amino acid sequences that have at least 80% amino acid identity with at least one of the amino acid sequences of SEQ ID NO's: 370-375;

f) amino acid sequences that have 3, 2, or 1 amino acid difference with at least one of the amino acid sequences of SEQ ID NO's: 370-375;

and/or

CDR3 is chosen from the group consisting of:

g) the amino acid sequences of SEQ ID NO's: 382-387;

h) amino acid sequences that have at least 80% amino acid identity with at least one of the amino acid sequences of SEQ ID NO's: 382-387;

i) amino acid sequences that have 3, 2, or 1 amino acid difference with at least one of the amino acid sequences of SEQ ID NO's: 382-387.

In particular, such an amino acid sequence of the invention may be such that CDR1 is chosen from the group consisting of the amino acid sequences of SEQ ID NO's: 358-363; and/or CDR2 is chosen from the group consisting of the amino acid sequences of SEQ ID NO's: 370-375; and/or CDR3 is chosen from the group consisting of the amino acid sequences of SEQ ID NO's: 382-387.

In particular, when the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:

a) the amino acid sequences of SEQ ID NO's: 358-363;

b) amino acid sequences that have at least 80% amino acid identity with at least one of the amino acid sequences of SEQ ID NO's: 358-363;

c) amino acid sequences that have 3, 2, or 1 amino acid difference with at least one of the amino acid sequences of SEQ ID NO's: 358-363;

and

CDR2 is chosen from the group consisting of:

d) the amino acid sequences of SEQ ID NO's: 370-375;

e) amino acid sequences that have at least 80% amino acid identity with at least one of the amino acid sequences of SEQ ID NO's: 370-375;

f) amino acid sequences that have 3, 2, or 1 amino acid difference with at least one of the amino acid sequences of SEQ ID NO's: 370-375;

and

CDR3 is chosen from the group consisting of:

g) the amino acid sequences of SEQ ID NO's: 382-387;

h) amino acid sequences that have at least 80% amino acid identity with at least one of the amino acid sequences of SEQ ID NO's: 382-387;

i) amino acid sequences that have 3, 2, or 1 amino acid difference with at least one of the amino acid sequences of SEQ ID NO's: 382-387; or any suitable fragment of such an amino acid sequence In particular, such an amino acid sequence of the invention may be such that CDR1 is chosen from the group consisting of the amino acid sequences of SEQ ID NO's: 358-363; and CDR2 is chosen from the group consisting of the amino acid sequences of SEQ ID NO's: 370-375; and CDR3 is chosen from the group consisting of the amino acid sequences of SEQ ID NO's: 382-387.

Again, preferred combinations of CDR sequences will become clear from the further description herein.

Also, such amino acid sequences are preferably such that they can specifically bind (as defined herein) to PD-L1; and more in particular bind to PD-L1 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In one preferred, but non-limiting aspect, the invention relates to an amino acid sequence that essentially consists of 4 framework regions (FR1 to FR4, respectively) and 3 complementarity determining regions (CDR1 to CDR3, respectively), in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 394-399. This degree of amino acid identity can for example be determined by determining the degree of amino acid identity (in a manner described herein) between said amino acid sequence and one or more of the sequences of SEQ ID NO's: 394-399, in which the amino acid residues that form the framework regions are disregarded. Such amino acid sequences of the invention can be as further described herein.

In another specific, but non-limiting aspect, the invention relates to an amino acid sequence directed against PD-L2, that comprises one or more stretches of amino acid residues chosen from the group consisting of:
a) the amino acid sequences of SEQ ID NO's: 407-413;
b) amino acid sequences that have at least 80% amino acid identity with at least one of the amino acid sequences of SEQ ID NO's: 407-413;
c) amino acid sequences that have 3, 2, or 1 amino acid difference with at least one of the amino acid sequences of SEQ ID NO's: 407-413;
d) the amino acid sequences of SEQ ID NO's: 421-427;
e) amino acid sequences that have at least 80% amino acid identity with at least one of the amino acid sequences of SEQ ID NO's: 421-427;
f) amino acid sequences that have 3, 2, or 1 amino acid difference with at least one of the amino acid sequences of SEQ ID NO's: 421-427;
g) the amino acid sequences of SEQ ID NO's: 435-441;
h) amino acid sequences that have at least 80% amino acid identity with at least one of the amino acid sequences of SEQ ID NO's: 435-441;
i) amino acid sequences that have 3, 2, or 1 amino acid difference with at least one of the amino acid sequences of SEQ ID NO's: 435-441;
or any suitable combination thereof.

When an amino acid sequence of the invention contains one or more amino acid sequences according to b) and/or c):
i) any amino acid substitution in such an amino acid sequence according to b) and/or c) is preferably, and compared to the corresponding amino acid sequence according to a), a conservative amino acid substitution, (as defined herein);
and/or
ii) the amino acid sequence according to b) and/or c) preferably only contains amino acid substitutions, and no amino acid deletions or insertions, compared to the corresponding amino acid sequence according to a);
and/or
iii) the amino acid sequence according to b) and/or c) may be an amino acid sequence that is derived from an amino acid sequence according to a) by means of affinity maturation using one or more techniques of affinity maturation known per se.

Similarly, when an amino acid sequence of the invention contains one or more amino acid sequences according to e) and/or f):
i) any amino acid substitution in such an amino acid sequence according to e) and/or f) is preferably, and compared to the corresponding amino acid sequence according to d), a conservative amino acid substitution, (as defined herein);
and/or
ii) the amino acid sequence according to e) and/or f) preferably only contains amino acid substitutions, and no amino acid deletions or insertions, compared to the corresponding amino acid sequence according to d);
and/or
iii) the amino acid sequence according to e) and/or f) may be an amino acid sequence that is derived from an amino acid sequence according to d) by means of affinity maturation using one or more techniques of affinity maturation known per se.

Also, similarly, when an amino acid sequence of the invention contains one or more amino acid sequences according to h) and/or i):
i) any amino acid substitution in such an amino acid sequence according to h) and/or i) is preferably, and compared to the corresponding amino acid sequence according to g), a conservative amino acid substitution, (as defined herein);
and/or
ii) the amino acid sequence according to h) and/or i) preferably only contains amino acid substitutions, and no amino acid deletions or insertions, compared to the corresponding amino acid sequence according to g);
and/or
iii) the amino acid sequence according to h) and/or i) may be an amino acid sequence that is derived from an amino acid sequence according to g) by means of affinity maturation using one or more techniques of affinity maturation known per se.

It should be understood that the last preceding paragraphs also generally apply to any amino acid sequences of the invention that comprise one or more amino acid sequences according to b), c), e), f), h) or i), respectively.

In this specific aspect, the amino acid sequence preferably comprises one or more stretches of amino acid residues chosen from the group consisting of:
i) the amino acid sequences of SEQ ID NO's: 407-413;
ii) the amino acid sequences of SEQ ID NO's: 421-427; and
iii) the amino acid sequences of SEQ ID NO's: 435-441;
or any suitable combination thereof.

Also, preferably, in such an amino acid sequence, at least one of said stretches of amino acid residues forms part of the antigen binding site for binding against PD-L2.

In a more specific, but again non-limiting aspect, the invention relates to an amino acid sequence directed against PD-L2, that comprises two or more stretches of amino acid residues chosen from the group consisting of:
a) the amino acid sequences of SEQ ID NO's: 407-413;
b) amino acid sequences that have at least 80% amino acid identity with at least one of the amino acid sequences of SEQ ID NO's: 407-413;
c) amino acid sequences that have 3, 2, or 1 amino acid difference with at least one of the amino acid sequences of SEQ ID NO's: 407-413;
d) the amino acid sequences of SEQ ID NO's: 421-427;
e) amino acid sequences that have at least 80% amino acid identity with at least one of the amino acid sequences of SEQ ID NO's: 421-427;
f) amino acid sequences that have 3, 2, or 1 amino acid difference with at least one of the amino acid sequences of SEQ ID NO's: 421-427;
g) the amino acid sequences of SEQ ID NO's: 435-441;
h) amino acid sequences that have at least 80% amino acid identity with at least one of the amino acid sequences of SEQ ID NO's: 435-441;

i) amino acid sequences that have 3, 2, or 1 amino acid difference with at least one of the amino acid sequences of SEQ ID NO's: 435-441;

such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

In this specific aspect, the amino acid sequence preferably comprises two or more stretches of amino acid residues chosen from the group consisting of:
i) the amino acid sequences of SEQ ID NO's: 407-413;
ii) the amino acid sequences of SEQ ID NO's: 421-427; and
iii) the amino acid sequences of SEQ ID NO's: 435-441;
such that, (i) when the first stretch of amino acid residues corresponds to one of the amino acid sequences of SEQ ID NO's: 407-413, the second stretch of amino acid residues corresponds to one of the amino acid sequences of SEQ ID NO's: 421-427 or of SEQ ID NO's: 435-441; (ii) when the first stretch of amino acid residues corresponds to one of the amino acid sequences of SEQ ID NO's: 421-427, the second stretch of amino acid residues corresponds to one of the amino acid sequences of SEQ ID NO's: 407-403 or of SEQ ID NO's: 435-441; or (iii) when the first stretch of amino acid residues corresponds to one of the amino acid sequences of SEQ ID NO's: 435-441, the second stretch of amino acid residues corresponds to one of the amino acid sequences of SEQ ID NO's: 407-413 or of SEQ ID NO's: 421-427.

Also, in such an amino acid sequence, the at least two stretches of amino acid residues again preferably form part of the antigen binding site for binding against PD-L2.

In an even more specific, but non-limiting aspect, the invention relates to an amino acid sequence directed against PD-L2, that comprises three or more stretches of amino acid residues, in which the first stretch of amino acid residues is chosen from the group consisting of:
a) the amino acid sequences of SEQ ID NO's: 407-413;
b) amino acid sequences that have at least 80% amino acid identity with at least one of the amino acid sequences of SEQ ID NO's: 407-413;
c) amino acid sequences that have 3, 2, or 1 amino acid difference with at least one of the amino acid sequences of SEQ ID NO's: 407-413;
the second stretch of amino acid residues is chosen from the group consisting of:
d) the amino acid sequences of SEQ ID NO's: 421-427;
e) amino acid sequences that have at least 80% amino acid identity with at least one of the amino acid sequences of SEQ ID NO's: 421-427;
f) amino acid sequences that have 3, 2, or 1 amino acid difference with at least one of the amino acid sequences of SEQ ID NO's: 421-427;
and the third stretch of amino acid residues is chosen from the group consisting of:
g) the amino acid sequences of SEQ ID NO's: 435-441;
h) amino acid sequences that have at least 80% amino acid identity with at least one of the amino acid sequences of SEQ ID NO's: 435-441;
i) amino acid sequences that have 3, 2, or 1 amino acid difference with at least one of the amino acid sequences of SEQ ID NO's: 435-441.

Preferably, in this specific aspect, the first stretch of amino acid residues is chosen from the group consisting of the amino acid sequences of SEQ ID NO's: 407-413; the second stretch of amino acid residues is chosen from the group consisting of the amino acid sequences of SEQ ID NO's: 421-427; and the third stretch of amino acid residues is chosen from the group consisting of the amino acid sequences of SEQ ID NO's: 435-441.

Again, preferably, in such an amino acid sequence, the at least three stretches of amino acid residues forms part of the antigen binding site for binding against PD-L2.

Preferred combinations of such stretches of amino acid sequences will become clear from the further disclosure herein.

Preferably, in such amino acid sequences the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 449-455. This degree of amino acid identity can for example be determined by determining the degree of amino acid identity (in a manner described herein) between said amino acid sequence and one or more of the sequences of SEQ ID NO's: 449-455, in which the amino acid residues that form the framework regions are disregarded. Also, such amino acid sequences of the invention can be as further described herein.

Also, such amino acid sequences are preferably such that they can specifically bind (as defined herein) to PD-L2; and more in particular bind to PD-L2 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

When the amino acid sequence of the invention essentially consists of 4 framework regions (FR1 to FR4, respectively) and 3 complementarity determining regions (CDR1 to CDR3, respectively), the amino acid sequence of the invention is preferably such that:
CDR1 is chosen from the group consisting of:
a) the amino acid sequences of SEQ ID NO's: 407-413;
b) amino acid sequences that have at least 80% amino acid identity with at least one of the amino acid sequences of SEQ ID NO's: 407-413;
c) amino acid sequences that have 3, 2, or 1 amino acid difference with at least one of the amino acid sequences of SEQ ID NO's: 407-413;
and/or
CDR2 is chosen from the group consisting of:
d) the amino acid sequences of SEQ ID NO's: 421-427;
e) amino acid sequences that have at least 80% amino acid identity with at least one of the amino acid sequences of SEQ ID NO's: 421-427;
f) amino acid sequences that have 3, 2, or 1 amino acid difference with at least one of the amino acid sequences of SEQ ID NO's: 421-427;
and/or
CDR3 is chosen from the group consisting of:
g) the amino acid sequences of SEQ ID NO's: 435-441;
h) amino acid sequences that have at least 80% amino acid identity with at least one of the amino acid sequences of SEQ ID NO's: 435-441;

i) amino acid sequences that have 3, 2, or 1 amino acid difference with at least one of the amino acid sequences of SEQ ID NO's: 435-441.

In particular, such an amino acid sequence of the invention may be such that CDR1 is chosen from the group consisting of the amino acid sequences of SEQ ID NO's: 407-413; and/or CDR2 is chosen from the group consisting of the amino acid sequences of SEQ ID NO's: 421-427; and/or CDR3 is chosen from the group consisting of the amino acid sequences of SEQ ID NO's: 435-441.

In particular, when the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:
a) the amino acid sequences of SEQ ID NO's: 407-413;
b) amino acid sequences that have at least 80% amino acid identity with at least one of the amino acid sequences of SEQ ID NO's: 407-413;
c) amino acid sequences that have 3, 2, or 1 amino acid difference with at least one of the amino acid sequences of SEQ ID NO's: 407-413;
and
CDR2 is chosen from the group consisting of:
d) the amino acid sequences of SEQ ID NO's: 421-427;
e) amino acid sequences that have at least 80% amino acid identity with at least one of the amino acid sequences of SEQ ID NO's: 421-427;
f) amino acid sequences that have 3, 2, or 1 amino acid difference with at least one of the amino acid sequences of SEQ ID NO's: 421-427;
and
CDR3 is chosen from the group consisting of:
g) the amino acid sequences of SEQ ID NO's: 435-441;
h) amino acid sequences that have at least 80% amino acid identity with at least one of the amino acid sequences of SEQ ID NO's: 435-441;
i) amino acid sequences that have 3, 2, or 1 amino acid difference with at least one of the amino acid sequences of SEQ ID NO's: 435-441; or any suitable fragment of such an amino acid sequence In particular, such an amino acid sequence of the invention may be such that CDR1 is chosen from the group consisting of the amino acid sequences of SEQ ID NO's: 407-413; and CDR2 is chosen from the group consisting of the amino acid sequences of SEQ ID NO's: 421-427; and CDR3 is chosen from the group consisting of the amino acid sequences of SEQ ID NO's: 435-441.

Again, preferred combinations of CDR sequences will become clear from the further description herein.

Also, such amino acid sequences are preferably such that they can specifically bind (as defined herein) to PD-L2; and more in particular bind to PD-L2 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In one preferred, but non-limiting aspect, the invention relates to an amino acid sequence that essentially consists of 4 framework regions (FR1 to FR4, respectively) and 3 complementarity determining regions (CDR1 to CDR3, respectively), in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 449-455. This degree of amino acid identity can for example be determined by determining the degree of amino acid identity (in a manner described herein) between said amino acid sequence and one or more of the sequences of SEQ ID NO's: 449-455, in which the amino acid residues that form the framework regions are disregarded. Such amino acid sequences of the invention can be as further described herein.

In another specific, but non-limiting aspect, the invention relates to an amino acid sequence directed against ICOSL, that comprises one or more stretches of amino acid residues chosen from the group consisting of:
a) the amino acid sequences of SEQ ID NO's: 463-469;
b) amino acid sequences that have at least 80% amino acid identity with at least one of the amino acid sequences of SEQ ID NO's: 463-469;
c) amino acid sequences that have 3, 2, or 1 amino acid difference with at least one of the amino acid sequences of SEQ ID NO's: 463-469;
d) the amino acid sequences of SEQ ID NO's: 477-483;
e) amino acid sequences that have at least 80% amino acid identity with at least one of the amino acid sequences of SEQ ID NO's: 477-483;
f) amino acid sequences that have 3, 2, or 1 amino acid difference with at least one of the amino acid sequences of SEQ ID NO's: 477-483;
g) the amino acid sequences of SEQ ID NO's: 491-497;
h) amino acid sequences that have at least 80% amino acid identity with at least one of the amino acid sequences of SEQ ID NO's: 491-497;
i) amino acid sequences that have 3, 2, or 1 amino acid difference with at least one of the amino acid sequences of SEQ ID NO's: 491-497;
or any suitable combination thereof.

When an amino acid sequence of the invention contains one or more amino acid sequences according to b) and/or c):
i) any amino acid substitution in such an amino acid sequence according to b) and/or c) is preferably, and compared to the corresponding amino acid sequence according to a), a conservative amino acid substitution, (as defined herein);
and/or
ii) the amino acid sequence according to b) and/or c) preferably only contains amino acid substitutions, and no amino acid deletions or insertions, compared to the corresponding amino acid sequence according to a);
and/or
iii) the amino acid sequence according to b) and/or c) may be an amino acid sequence that is derived from an amino acid sequence according to a) by means of affinity maturation using one or more techniques of affinity maturation known per se.

Similarly, when an amino acid sequence of the invention contains one or more amino acid sequences according to e) and/or f):
i) any amino acid substitution in such an amino acid sequence according to e) and/or f) is preferably, and compared to the corresponding amino acid sequence according to d), a conservative amino acid substitution, (as defined herein);
and/or
ii) the amino acid sequence according to e) and/or f) preferably only contains amino acid substitutions, and no amino acid deletions or insertions, compared to the corresponding amino acid sequence according to d);
and/or
iii) the amino acid sequence according to e) and/or f) may be an amino acid sequence that is derived from an amino acid sequence according to d) by means of affinity maturation using one or more techniques of affinity maturation known per se.

Also, similarly, when an amino acid sequence of the invention contains one or more amino acid sequences according to h) and/or i):

i) any amino acid substitution in such an amino acid sequence according to h) and/or i) is preferably, and compared to the corresponding amino acid sequence according to g), a conservative amino acid substitution, (as defined herein); and/or ii) the amino acid sequence according to h) and/or i) preferably only contains amino acid substitutions, and no amino acid deletions or insertions, compared to the corresponding amino acid sequence according to g); and/or iii) the amino acid sequence according to h) and/or i) may be an amino acid sequence that is derived from an amino acid sequence according to g) by means of affinity maturation using one or more techniques of affinity maturation known per se.

It should be understood that the last preceding paragraphs also generally apply to any amino acid sequences of the invention that comprise one or more amino acid sequences according to b), c), e), f), h) or i), respectively.

In this specific aspect, the amino acid sequence preferably comprises one or more stretches of amino acid residues chosen from the group consisting of:
i) the amino acid sequences of SEQ ID NO's: 463-469;
ii) the amino acid sequences of SEQ ID NO's: 477-483; and
iii) the amino acid sequences of SEQ ID NO's: 491-497;
or any suitable combination thereof.

Also, preferably, in such an amino acid sequence, at least one of said stretches of amino acid residues forms part of the antigen binding site for binding against ICOSL.

In a more specific, but again non-limiting aspect, the invention relates to an amino acid sequence directed against ICOSL, that comprises two or more stretches of amino acid residues chosen from the group consisting of:
a) the amino acid sequences of SEQ ID NO's: 463-469;
b) amino acid sequences that have at least 80% amino acid identity with at least one of the amino acid sequences of SEQ ID NO's: 463-469;
c) amino acid sequences that have 3, 2, or 1 amino acid difference with at least one of the amino acid sequences of SEQ ID NO's: 463-469;
d) the amino acid sequences of SEQ ID NO's: 477-483;
e) amino acid sequences that have at least 80% amino acid identity with at least one of the amino acid sequences of SEQ ID NO's: 477-483;
f) amino acid sequences that have 3, 2, or 1 amino acid difference with at least one of the amino acid sequences of SEQ ID NO's: 477-483;
g) the amino acid sequences of SEQ ID NO's: 491-497;
h) amino acid sequences that have at least 80% amino acid identity with at least one of the amino acid sequences of SEQ ID NO's: 491-497;
i) amino acid sequences that have 3, 2, or 1 amino acid difference with at least one of the amino acid sequences of SEQ ID NO's: 491-497;
such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

In this specific aspect, the amino acid sequence preferably comprises two or more stretches of amino acid residues chosen from the group consisting of:
i) the amino acid sequences of SEQ ID NO's: 463-469;
ii) the amino acid sequences of SEQ ID NO's: 477-483; and
iii) the amino acid sequences of SEQ ID NO's: 491-497;
such that, (i) when the first stretch of amino acid residues corresponds to one of the amino acid sequences of SEQ ID NO's: 463-469, the second stretch of amino acid residues corresponds to one of the amino acid sequences of SEQ ID NO's: 477-483 or of SEQ ID NO's: 491-497; (ii) when the first stretch of amino acid residues corresponds to one of the amino acid sequences of SEQ ID NO's: 477-483, the second stretch of amino acid residues corresponds to one of the amino acid sequences of SEQ ID NO's: 463-469 or of SEQ ID NO's: 491-497; or (iii) when the first stretch of amino acid residues corresponds to one of the amino acid sequences of SEQ ID NO's: 491-497, the second stretch of amino acid residues corresponds to one of the amino acid sequences of SEQ ID NO's: 463-469 or of SEQ ID NO's: 477-483.

Also, in such an amino acid sequence, the at least two stretches of amino acid residues again preferably form part of the antigen binding site for binding against ICOSL.

In an even more specific, but non-limiting aspect, the invention relates to an amino acid sequence directed against ICOSL, that comprises three or more stretches of amino acid residues, in which the first stretch of amino acid residues is chosen from the group consisting of:
a) the amino acid sequences of SEQ ID NO's: 463-469;
b) amino acid sequences that have at least 80% amino acid identity with at least one of the amino acid sequences of SEQ ID NO's: 463-469;
c) amino acid sequences that have 3, 2, or 1 amino acid difference with at least one of the amino acid sequences of SEQ ID NO's: 463-469;
the second stretch of amino acid residues is chosen from the group consisting of:
d) the amino acid sequences of SEQ ID NO's: 477-483;
e) amino acid sequences that have at least 80% amino acid identity with at least one of the amino acid sequences of SEQ ID NO's: 477-483;
f) amino acid sequences that have 3, 2, or 1 amino acid difference with at least one of the amino acid sequences of SEQ ID NO's: 477-483;
and the third stretch of amino acid residues is chosen from the group consisting of:
g) the amino acid sequences of SEQ ID NO's: 491-497;
h) amino acid sequences that have at least 80% amino acid identity with at least one of the amino acid sequences of SEQ ID NO's: 491-497;
i) amino acid sequences that have 3, 2, or 1 amino acid difference with at least one of the amino acid sequences of SEQ ID NO's: 491-497.

Preferably, in this specific aspect, the first stretch of amino acid residues is chosen from the group consisting of the amino acid sequences of SEQ ID NO's: 463-469; the second stretch of amino acid residues is chosen from the group consisting of the amino acid sequences of SEQ ID NO's: 477-483; and the third stretch of amino acid residues is chosen from the group consisting of the amino acid sequences of SEQ ID NO's: 491-497.

Again, preferably, in such an amino acid sequence, the at least three stretches of amino acid residues forms part of the antigen binding site for binding against ICOSL.

Preferred combinations of such stretches of amino acid sequences will become clear from the further disclosure herein.

Preferably, in such amino acid sequences the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 505-511. This degree of amino acid identity can for example be determined by determining the degree of amino acid identity (in a manner described herein) between said amino acid sequence and one or more of the sequences of SEQ ID NO's: 505-511, in which the amino acid residues that form the framework regions are disregarded. Also, such amino acid sequences of the invention can be as further described herein.

Also, such amino acid sequences are preferably such that they can specifically bind (as defined herein) to ICOSL; and more in particular bind to ICOSL with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

When the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:

a) the amino acid sequences of SEQ ID NO's: 463-469;

b) amino acid sequences that have at least 80% amino acid identity with at least one of the amino acid sequences of SEQ ID NO's: 463-469;

c) amino acid sequences that have 3, 2, or 1 amino acid difference with at least one of the amino acid sequences of SEQ ID NO's: 463-469;

and/or

CDR2 is chosen from the group consisting of:

d) the amino acid sequences of SEQ ID NO's: 477-483;

e) amino acid sequences that have at least 80% amino acid identity with at least one of the amino acid sequences of SEQ ID NO's: 477-483;

f) amino acid sequences that have 3, 2, or 1 amino acid difference with at least one of the amino acid sequences of SEQ ID NO's: 477-483;

and/or

CDR3 is chosen from the group consisting of:

g) the amino acid sequences of SEQ ID NO's: 491-497;

h) amino acid sequences that have at least 80% amino acid identity with at least one of the amino acid sequences of SEQ ID NO's: 491-497;

i) amino acid sequences that have 3, 2, or 1 amino acid difference with at least one of the amino acid sequences of SEQ ID NO's: 491-497.

In particular, such an amino acid sequence of the invention may be such that CDR1 is chosen from the group consisting of the amino acid sequences of SEQ ID NO's: 463-469; and/or CDR2 is chosen from the group consisting of the amino acid sequences of SEQ ID NO's: 477-483; and/or CDR3 is chosen from the group consisting of the amino acid sequences of SEQ ID NO's: 491-497.

In particular, when the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:

a) the amino acid sequences of SEQ ID NO's: 463-469;

b) amino acid sequences that have at least 80% amino acid identity with at least one of the amino acid sequences of SEQ ID NO's: 463-469;

c) amino acid sequences that have 3, 2, or 1 amino acid difference with at least one of the amino acid sequences of SEQ ID NO's: 463-469;

and

CDR2 is chosen from the group consisting of:

d) the amino acid sequences of SEQ ID NO's: 477-483;

e) amino acid sequences that have at least 80% amino acid identity with at least one of the amino acid sequences of SEQ ID NO's: 477-483;

f) amino acid sequences that have 3, 2, or 1 amino acid difference with at least one of the amino acid sequences of SEQ ID NO's: 477-483;

and

CDR3 is chosen from the group consisting of:

g) the amino acid sequences of SEQ ID NO's: 491-497;

h) amino acid sequences that have at least 80% amino acid identity with at least one of the amino acid sequences of SEQ ID NO's: 491-497;

i) amino acid sequences that have 3, 2, or 1 amino acid difference with at least one of the amino acid sequences of SEQ ID NO's: 491-497; or any suitable fragment of such an amino acid sequence In particular, such an amino acid sequence of the invention may be such that CDR1 is chosen from the group consisting of the amino acid sequences of SEQ ID NO's: 463-469; and CDR2 is chosen from the group consisting of the amino acid sequences of SEQ ID NO's: 477-483; and CDR3 is chosen from the group consisting of the amino acid sequences of SEQ ID NO's: 491-497.

Again, preferred combinations of CDR sequences will become clear from the further description herein.

Also, such amino acid sequences are preferably such that they can specifically bind (as defined herein) to ICOSL; and more in particular bind to ICOSL with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In one preferred, but non-limiting aspect, the invention relates to an amino acid sequence that essentially consists of 4 framework regions (FR1 to FR4, respectively) and 3 complementarity determining regions (CDR1 to CDR3, respectively), in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 505-511. This degree of amino acid identity can for example be determined by determining the degree of amino acid identity (in a manner described herein) between said amino acid sequence and one or more of the sequences of SEQ ID NO's: 505-511, in which the amino acid residues that form the framework regions are disregarded. Such amino acid sequences of the invention can be as further described herein.

In another specific, but non-limiting aspect, the invention relates to an amino acid sequence directed against CD28, that comprises one or more stretches of amino acid residues chosen from the group consisting of:

a) the amino acid sequences of SEQ ID NO's: 518-523;
b) amino acid sequences that have at least 80% amino acid identity with at least one of the amino acid sequences of SEQ ID NO's: 518-523;
c) amino acid sequences that have 3, 2, or 1 amino acid difference with at least one of the amino acid sequences of SEQ ID NO's: 518-523;
d) the amino acid sequences of SEQ ID NO's: 530-535;
e) amino acid sequences that have at least 80% amino acid identity with at least one of the amino acid sequences of SEQ ID NO's: 530-535;
f) amino acid sequences that have 3, 2, or 1 amino acid difference with at least one of the amino acid sequences of SEQ ID NO's: 530-535;
g) the amino acid sequences of SEQ ID NO's: 542-547;
h) amino acid sequences that have at least 80% amino acid identity with at least one of the amino acid sequences of SEQ ID NO's: 542-547;
i) amino acid sequences that have 3, 2, or 1 amino acid difference with at least one of the amino acid sequences of SEQ ID NO's: 542-547;
or any suitable combination thereof.

When an amino acid sequence of the invention contains one or more amino acid sequences according to b) and/or c):
i) any amino acid substitution in such an amino acid sequence according to b) and/or c) is preferably, and compared to the corresponding amino acid sequence according to a), a conservative amino acid substitution, (as defined herein);
and/or
ii) the amino acid sequence according to b) and/or c) preferably only contains amino acid substitutions, and no amino acid deletions or insertions, compared to the corresponding amino acid sequence according to a);
and/or
iii) the amino acid sequence according to b) and/or c) may be an amino acid sequence that is derived from an amino acid sequence according to a) by means of affinity maturation using one or more techniques of affinity maturation known per se.

Similarly, when an amino acid sequence of the invention contains one or more amino acid sequences according to e) and/or f):
i) any amino acid substitution in such an amino acid sequence according to e) and/or f) is preferably, and compared to the corresponding amino acid sequence according to d), a conservative amino acid substitution, (as defined herein);
and/or
ii) the amino acid sequence according to e) and/or f) preferably only contains amino acid substitutions, and no amino acid deletions or insertions, compared to the corresponding amino acid sequence according to d);
and/or
iii) the amino acid sequence according to e) and/or f) may be an amino acid sequence that is derived from an amino acid sequence according to d) by means of affinity maturation using one or more techniques of affinity maturation known per se.

Also, similarly, when an amino acid sequence of the invention contains one or more amino acid sequences according to h) and/or i):
i) any amino acid substitution in such an amino acid sequence according to h) and/or i) is preferably, and compared to the corresponding amino acid sequence according to g), a conservative amino acid substitution, (as defined herein);
and/or
ii) the amino acid sequence according to h) and/or i) preferably only contains amino acid substitutions, and no amino acid deletions or insertions, compared to the corresponding amino acid sequence according to g);
and/or
iii) the amino acid sequence according to h) and/or i) may be an amino acid sequence that is derived from an amino acid sequence according to g) by means of affinity maturation using one or more techniques of affinity maturation known per se.

It should be understood that the last preceding paragraphs also generally apply to any amino acid sequences of the invention that comprise one or more amino acid sequences according to b), c), e), f), h) or i), respectively.

In this specific aspect, the amino acid sequence preferably comprises one or more stretches of amino acid residues chosen from the group consisting of:
i) the amino acid sequences of SEQ ID NO's: 518-523;
ii) the amino acid sequences of SEQ ID NO's: 530-535; and
iii) the amino acid sequences of SEQ ID NO's: 542-547;
or any suitable combination thereof.

Also, preferably, in such an amino acid sequence, at least one of said stretches of amino acid residues forms part of the antigen binding site for binding against CD28.

In a more specific, but again non-limiting aspect, the invention relates to an amino acid sequence directed against CD28, that comprises two or more stretches of amino acid residues chosen from the group consisting of:

a) the amino acid sequences of SEQ ID NO's: 518-523;
b) amino acid sequences that have at least 80% amino acid identity with at least one of the amino acid sequences of SEQ ID NO's: 518-523;
c) amino acid sequences that have 3, 2, or 1 amino acid difference with at least one of the amino acid sequences of SEQ ID NO's: 518-523;
d) the amino acid sequences of SEQ ID NO's: 530-535;
e) amino acid sequences that have at least 80% amino acid identity with at least one of the amino acid sequences of SEQ ID NO's: 530-535;
f) amino acid sequences that have 3, 2, or 1 amino acid difference with at least one of the amino acid sequences of SEQ ID NO's: 530-535;
g) the amino acid sequences of SEQ ID NO's: 542-547;
h) amino acid sequences that have at least 80% amino acid identity with at least one of the amino acid sequences of SEQ ID NO's: 542-547;
i) amino acid sequences that have 3, 2, or 1 amino acid difference with at least one of the amino acid sequences of SEQ ID NO's: 542-547;

such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

In this specific aspect, the amino acid sequence preferably comprises two or more stretches of amino acid residues chosen from the group consisting of:

i) the amino acid sequences of SEQ ID NO's: 518-523;
ii) the amino acid sequences of SEQ ID NO's: 530-535; and
iii) the amino acid sequences of SEQ ID NO's: 542-547;

such that, (i) when the first stretch of amino acid residues corresponds to one of the amino acid sequences of SEQ ID NO's: 518-523, the second stretch of amino acid residues corresponds to one of the amino acid sequences of SEQ ID NO's: 530-535 or of SEQ ID NO's: 542-547; (ii) when the first stretch of amino acid residues corresponds to one of the amino acid sequences of SEQ ID NO's: 530-535, the second stretch of amino acid residues corresponds to one of the amino acid sequences of SEQ ID NO's: 518-523 or of SEQ ID NO's: 542-547; or (iii) when the first stretch of amino acid residues corresponds to one of the amino acid sequences of SEQ ID NO's: 542-547, the second stretch of amino acid residues corresponds to one of the amino acid sequences of SEQ ID NO's: 518-523 or of SEQ ID NO's: 530-535.

Also, in such an amino acid sequence, the at least two stretches of amino acid residues again preferably form part of the antigen binding site for binding against CD28.

In an even more specific, but non-limiting aspect, the invention relates to an amino acid sequence directed against CD28, that comprises three or more stretches of amino acid residues, in which the first stretch of amino acid residues is chosen from the group consisting of:
a) the amino acid sequences of SEQ ID NO's: 518-523;
b) amino acid sequences that have at least 80% amino acid identity with at least one of the amino acid sequences of SEQ ID NO's: 518-523;
c) amino acid sequences that have 3, 2, or 1 amino acid difference with at least one of the amino acid sequences of SEQ ID NO's: 518-523;
the second stretch of amino acid residues is chosen from the group consisting of:
d) the amino acid sequences of SEQ ID NO's: 530-535;
e) amino acid sequences that have at least 80% amino acid identity with at least one of the amino acid sequences of SEQ ID NO's: 530-535;
f) amino acid sequences that have 3, 2, or 1 amino acid difference with at least one of the amino acid sequences of SEQ ID NO's: 530-535;
and the third stretch of amino acid residues is chosen from the group consisting of:
g) the amino acid sequences of SEQ ID NO's: 542-547;
h) amino acid sequences that have at least 80% amino acid identity with at least one of the amino acid sequences of SEQ ID NO's: 542-547;
i) amino acid sequences that have 3, 2, or 1 amino acid difference with at least one of the amino acid sequences of SEQ ID NO's: 542-547.

Preferably, in this specific aspect, the first stretch of amino acid residues is chosen from the group consisting of the amino acid sequences of SEQ ID NO's: 518-523; the second stretch of amino acid residues is chosen from the group consisting of the amino acid sequences of SEQ ID NO's: 530-535; and the third stretch of amino acid residues is chosen from the group consisting of the amino acid sequences of SEQ ID NO's: 542-547.

Again, preferably, in such an amino acid sequence, the at least three stretches of amino acid residues forms part of the antigen binding site for binding against CD28.

Preferred combinations of such stretches of amino acid sequences will become clear from the further disclosure herein.

Preferably, in such amino acid sequences the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 554-559. This degree of amino acid identity can for example be determined by determining the degree of amino acid identity (in a manner described herein) between said amino acid sequence and one or more of the sequences of SEQ ID NO's: 554-559, in which the amino acid residues that form the framework regions are disregarded. Also, such amino acid sequences of the invention can be as further described herein.

Also, such amino acid sequences are preferably such that they can specifically bind (as defined herein) to CD28; and more in particular bind to CD28 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

When the amino acid sequence of the invention essentially consists of 4 framework regions (FR1 to FR4, respectively) and 3 complementarity determining regions (CDR1 to CDR3, respectively), the amino acid sequence of the invention is preferably such that:
CDR1 is chosen from the group consisting of:
a) the amino acid sequences of SEQ ID NO's: 518-523;
b) amino acid sequences that have at least 80% amino acid identity with at least one of the amino acid sequences of SEQ ID NO's: 518-523;
c) amino acid sequences that have 3, 2, or 1 amino acid difference with at least one of the amino acid sequences of SEQ ID NO's: 518-523;
and/or
CDR2 is chosen from the group consisting of:
d) the amino acid sequences of SEQ ID NO's: 530-535;
e) amino acid sequences that have at least 80% amino acid identity with at least one of the amino acid sequences of SEQ ID NO's: 530-535;
f) amino acid sequences that have 3, 2, or 1 amino acid difference with at least one of the amino acid sequences of SEQ ID NO's: 530-535;
and/or
CDR3 is chosen from the group consisting of:
g) the amino acid sequences of SEQ ID NO's: 542-547;
h) amino acid sequences that have at least 80% amino acid identity with at least one of the amino acid sequences of SEQ ID NO's: 542-547;
i) amino acid sequences that have 3, 2, or 1 amino acid difference with at least one of the amino acid sequences of SEQ ID NO's: 542-547.

In particular, such an amino acid sequence of the invention may be such that CDR1 is chosen from the group consisting of the amino acid sequences of SEQ ID NO's: 518-523; and/or CDR2 is chosen from the group consisting of the amino acid sequences of SEQ ID NO's: 530-535; and/or CDR3 is chosen from the group consisting of the amino acid sequences of SEQ ID NO's: 542-547.

In particular, when the amino acid sequence of the invention essentially consists of 4 framework regions (FR1 to FR4, respectively) and 3 complementarity determining regions (CDR1 to CDR3, respectively), the amino acid sequence of the invention is preferably such that:
CDR1 is chosen from the group consisting of:
a) the amino acid sequences of SEQ ID NO's: 518-523;
b) amino acid sequences that have at least 80% amino acid identity with at least one of the amino acid sequences of SEQ ID NO's: 518-523;

c) amino acid sequences that have 3, 2, or 1 amino acid difference with at least one of the amino acid sequences of SEQ ID NO's: 518-523;
and
CDR2 is chosen from the group consisting of:
d) the amino acid sequences of SEQ ID NO's: 530-535;
e) amino acid sequences that have at least 80% amino acid identity with at least one of the amino acid sequences of SEQ ID NO's: 530-535;
f) amino acid sequences that have 3, 2, or 1 amino acid difference with at least one of the amino acid sequences of SEQ ID NO's: 530-535;
and
CDR3 is chosen from the group consisting of:
g) the amino acid sequences of SEQ ID NO's: 542-547;
h) amino acid sequences that have at least 80% amino acid identity with at least one of the amino acid sequences of SEQ ID NO's: 542-547;
i) amino acid sequences that have 3, 2, or 1 amino acid difference with at least one of the amino acid sequences of SEQ ID NO's: 542-547; or any suitable fragment of such an amino acid sequence In particular, such an amino acid sequence of the invention may be such that CDR1 is chosen from the group consisting of the amino acid sequences of SEQ ID NO's: 518-523; and CDR2 is chosen from the group consisting of the amino acid sequences of SEQ ID NO's: 530-535; and CDR3 is chosen from the group consisting of the amino acid sequences of SEQ ID NO's: 542-547.

Again, preferred combinations of CDR sequences will become clear from the further description herein.

Also, such amino acid sequences are preferably such that they can specifically bind (as defined herein) to CD28; and more in particular bind to CD28 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In one preferred, but non-limiting aspect, the invention relates to an amino acid sequence that essentially consists of 4 framework regions (FR1 to FR4, respectively) and 3 complementarity determining regions (CDR1 to CDR3, respectively), in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 554-559. This degree of amino acid identity can for example be determined by determining the degree of amino acid identity (in a manner described herein) between said amino acid sequence and one or more of the sequences of SEQ ID NO's: 554-559, in which the amino acid residues that form the framework regions are disregarded. Such amino acid sequences of the invention can be as further described herein.

In another specific, but non-limiting aspect, the invention relates to an amino acid sequence directed against CTLA4, that comprises one or more stretches of amino acid residues chosen from the group consisting of:
a) the amino acid sequences of SEQ ID NO's: 664-767;
b) amino acid sequences that have at least 80% amino acid identity with at least one of the amino acid sequences of SEQ ID NO's: 664-767;
c) amino acid sequences that have 3, 2, or 1 amino acid difference with at least one of the amino acid sequences of SEQ ID NO's: 664-767;
d) the amino acid sequences of SEQ ID NO's: 872-975;
e) amino acid sequences that have at least 80% amino acid identity with at least one of the amino acid sequences of SEQ ID NO's: 872-975;
f) amino acid sequences that have 3, 2, or 1 amino acid difference with at least one of the amino acid sequences of SEQ ID NO's: 872-975;
g) the amino acid sequences of SEQ ID NO's: 1080-1183;
h) amino acid sequences that have at least 80% amino acid identity with at least one of the amino acid sequences of SEQ ID NO's: 1080-1183;
i) amino acid sequences that have 3, 2, or 1 amino acid difference with at least one of the amino acid sequences of SEQ ID NO's: 1080-1183;
or any suitable combination thereof.

When an amino acid sequence of the invention contains one or more amino acid sequences according to b) and/or c):
i) any amino acid substitution in such an amino acid sequence according to b) and/or c) is preferably, and compared to the corresponding amino acid sequence according to a), a conservative amino acid substitution, (as defined herein);
and/or
ii) the amino acid sequence according to b) and/or c) preferably only contains amino acid substitutions, and no amino acid deletions or insertions, compared to the corresponding amino acid sequence according to a);
and/or
iii) the amino acid sequence according to b) and/or c) may be an amino acid sequence that is derived from an amino acid sequence according to a) by means of affinity maturation using one or more techniques of affinity maturation known per se.

Similarly, when an amino acid sequence of the invention contains one or more amino acid sequences according to e) and/or f):
i) any amino acid substitution in such an amino acid sequence according to e) and/or f) is preferably, and compared to the corresponding amino acid sequence according to d), a conservative amino acid substitution, (as defined herein);
and/or
ii) the amino acid sequence according to e) and/or f) preferably only contains amino acid substitutions, and no amino acid deletions or insertions, compared to the corresponding amino acid sequence according to d);
and/or
iii) the amino acid sequence according to e) and/or f) may be an amino acid sequence that is derived from an amino acid sequence according to d) by means of affinity maturation using one or more techniques of affinity maturation known per se.

Also, similarly, when an amino acid sequence of the invention contains one or more amino acid sequences according to h) and/or i):
i) any amino acid substitution in such an amino acid sequence according to h) and/or i) is preferably, and compared to the corresponding amino acid sequence according to g), a conservative amino acid substitution, (as defined herein);
and/or
ii) the amino acid sequence according to h) and/or i) preferably only contains amino acid substitutions, and no amino acid deletions or insertions, compared to the corresponding amino acid sequence according to g);
and/or
iii) the amino acid sequence according to h) and/or i) may be an amino acid sequence that is derived from an amino acid sequence according to g) by means of affinity maturation using one or more techniques of affinity maturation known per se.

It should be understood that the last preceding paragraphs also generally apply to any amino acid sequences of the invention that comprise one or more amino acid sequences according to b), c), e), f), h) or i), respectively.

In this specific aspect, the amino acid sequence preferably comprises one or more stretches of amino acid residues chosen from the group consisting of:
i) the amino acid sequences of SEQ ID NO's: 664-767;
ii) the amino acid sequences of SEQ ID NO's: 872-975; and
iii) the amino acid sequences of SEQ ID NO's: 1080-1183; or any suitable combination thereof.

Also, preferably, in such an amino acid sequence, at least one of said stretches of amino acid residues forms part of the antigen binding site for binding against CTLA4.

In a more specific, but again non-limiting aspect, the invention relates to an amino acid sequence directed against CTLA4, that comprises two or more stretches of amino acid residues chosen from the group consisting of:
a) the amino acid sequences of SEQ ID NO's: 664-767;
b) amino acid sequences that have at least 80% amino acid identity with at least one of the amino acid sequences of SEQ ID NO's: 664-767;
c) amino acid sequences that have 3, 2, or 1 amino acid difference with at least one of the amino acid sequences of SEQ ID NO's: 664-767;
d) the amino acid sequences of SEQ ID NO's: 872-975;
e) amino acid sequences that have at least 80% amino acid identity with at least one of the amino acid sequences of SEQ ID NO's: 872-975;
f) amino acid sequences that have 3, 2, or 1 amino acid difference with at least one of the amino acid sequences of SEQ ID NO's: 872-975;
g) the amino acid sequences of SEQ ID NO's: 1080-1183;
h) amino acid sequences that have at least 80% amino acid identity with at least one of the amino acid sequences of SEQ ID NO's: 1080-1183;
i) amino acid sequences that have 3, 2, or 1 amino acid difference with at least one of the amino acid sequences of SEQ ID NO's: 1080-1183;
such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

In this specific aspect, the amino acid sequence preferably comprises two or more stretches of amino acid residues chosen from the group consisting of:
i) the amino acid sequences of SEQ ID NO's: 664-767;
ii) the amino acid sequences of SEQ ID NO's: 872-975; and
iii) the amino acid sequences of SEQ ID NO's: 1080-1183;
such that, (i) when the first stretch of amino acid residues corresponds to one of the amino acid sequences of SEQ ID NO's: 664-767, the second stretch of amino acid residues corresponds to one of the amino acid sequences of SEQ ID NO's: 872-975 or of SEQ ID NO's: 1080-1183; (ii) when the first stretch of amino acid residues corresponds to one of the amino acid sequences of SEQ ID NO's: 872-975, the second stretch of amino acid residues corresponds to one of the amino acid sequences of SEQ ID NO's: 664-767 or of SEQ ID NO's: 1080-1183; or (iii) when the first stretch of amino acid residues corresponds to one of the amino acid sequences of SEQ ID NO's: 1080-1183, the second stretch of amino acid residues corresponds to one of the amino acid sequences of SEQ ID NO's: 664-767 or of SEQ ID NO's: 872-975.

Also, in such an amino acid sequence, the at least two stretches of amino acid residues again preferably form part of the antigen binding site for binding against CTLA4.

In an even more specific, but non-limiting aspect, the invention relates to an amino acid sequence directed against CTLA4, that comprises three or more stretches of amino acid residues, in which the first stretch of amino acid residues is chosen from the group consisting of:
a) the amino acid sequences of SEQ ID NO's: 664-767;
b) amino acid sequences that have at least 80% amino acid identity with at least one of the amino acid sequences of SEQ ID NO's: 664-767;
c) amino acid sequences that have 3, 2, or 1 amino acid difference with at least one of the amino acid sequences of SEQ ID NO's: 664-767;
the second stretch of amino acid residues is chosen from the group consisting of:
d) the amino acid sequences of SEQ ID NO's: 872-975;
e) amino acid sequences that have at least 80% amino acid identity with at least one of the amino acid sequences of SEQ ID NO's: 872-975;
f) amino acid sequences that have 3, 2, or 1 amino acid difference with at least one of the amino acid sequences of SEQ ID NO's: 872-975;
and the third stretch of amino acid residues is chosen from the group consisting of:
g) the amino acid sequences of SEQ ID NO's: 1080-1183;
h) amino acid sequences that have at least 80% amino acid identity with at least one of the amino acid sequences of SEQ ID NO's: 1080-1183;
i) amino acid sequences that have 3, 2, or 1 amino acid difference with at least one of the amino acid sequences of SEQ ID NO's: 1080-1183.

Preferably, in this specific aspect, the first stretch of amino acid residues is chosen from the group consisting of the amino acid sequences of SEQ ID NO's: 664-767; the second stretch of amino acid residues is chosen from the group consisting of the amino acid sequences of SEQ ID NO's: 872-975; and the third stretch of amino acid residues is chosen from the group consisting of the amino acid sequences of SEQ ID NO's: 1080-1183.

Again, preferably, in such an amino acid sequence, the at least three stretches of amino acid residues forms part of the antigen binding site for binding against CTLA4.

Preferred combinations of such stretches of amino acid sequences will become clear from the further disclosure herein.

Preferably, in such amino acid sequences the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 1288-1391. This degree of amino acid identity can for example be determined by determining the degree of amino acid identity (in a manner described herein) between said amino acid sequence and one or more of the sequences of SEQ ID NO's: 1288-1391, in which the amino acid residues that form the framework regions are disregarded. Also, such amino acid sequences of the invention can be as further described herein.

Also, such amino acid sequences are preferably such that they can specifically bind (as defined herein) to CTLA4; and more in particular bind to CTLA4 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

When the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:
a) the amino acid sequences of SEQ ID NO's: 664-767;
b) amino acid sequences that have at least 80% amino acid identity with at least one of the amino acid sequences of SEQ ID NO's: 664-767;
c) amino acid sequences that have 3, 2, or 1 amino acid difference with at least one of the amino acid sequences of SEQ ID NO's: 664-767;
and/or
CDR2 is chosen from the group consisting of:
d) the amino acid sequences of SEQ ID NO's: 872-975;
e) amino acid sequences that have at least 80% amino acid identity with at least one of the amino acid sequences of SEQ ID NO's: 872-975;
f) amino acid sequences that have 3, 2, or 1 amino acid difference with at least one of the amino acid sequences of SEQ ID NO's: 872-975;
and/or
CDR3 is chosen from the group consisting of:
g) the amino acid sequences of SEQ ID NO's: 1080-1183;
h) amino acid sequences that have at least 80% amino acid identity with at least one of the amino acid sequences of SEQ ID NO's: 1080-1183;
i) amino acid sequences that have 3, 2, or 1 amino acid difference with at least one of the amino acid sequences of SEQ ID NO's: 1080-1183.

In particular, such an amino acid sequence of the invention may be such that CDR1 is chosen from the group consisting of the amino acid sequences of SEQ ID NO's: 664-767; and/or CDR2 is chosen from the group consisting of the amino acid sequences of SEQ ID NO's: 872-975; and/or CDR3 is chosen from the group consisting of the amino acid sequences of SEQ ID NO's: 1080-1183.

In particular, when the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:
a) the amino acid sequences of SEQ ID NO's: 664-767;
b) amino acid sequences that have at least 80% amino acid identity with at least one of the amino acid sequences of SEQ ID NO's: 664-767;
c) amino acid sequences that have 3, 2, or 1 amino acid difference with at least one of the amino acid sequences of SEQ ID NO's: 664-767;
and
CDR2 is chosen from the group consisting of:
d) the amino acid sequences of SEQ ID NO's: 872-975;
e) amino acid sequences that have at least 80% amino acid identity with at least one of the amino acid sequences of SEQ ID NO's: 872-975;
f) amino acid sequences that have 3, 2, or 1 amino acid difference with at least one of the amino acid sequences of SEQ ID NO's: 872-975;
and
CDR3 is chosen from the group consisting of:
g) the amino acid sequences of SEQ ID NO's: 1080-1183;
h) amino acid sequences that have at least 80% amino acid identity with at least one of the amino acid sequences of SEQ ID NO's: 1080-1183;
i) amino acid sequences that have 3, 2, or 1 amino acid difference with at least one of the amino acid sequences of SEQ ID NO's: 1080-1183; or any suitable fragment of such an amino acid sequence In particular, such an amino acid sequence of the invention may be such that CDR1 is chosen from the group consisting of the amino acid sequences of SEQ ID NO's: 664-767; and CDR2 is chosen from the group consisting of the amino acid sequences of SEQ ID NO's: 872-975; and CDR3 is chosen from the group consisting of the amino acid sequences of SEQ ID NO's: 1080-1183.

Again, preferred combinations of CDR sequences will become clear from the further description herein.

Also, such amino acid sequences are preferably such that they can specifically bind (as defined herein) to CTLA4; and more in particular bind to CTLA4 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In one preferred, but non-limiting aspect, the invention relates to an amino acid sequence that essentially consists of 4 framework regions (FR1 to FR4, respectively) and 3 complementarity determining regions (CDR1 to CDR3, respectively), in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 1288-1391. This degree of amino acid identity can for example be determined by determining the degree of amino acid identity (in a manner described herein) between said amino acid sequence and one or more of the sequences of SEQ ID NO's: 1288-1391, in which the amino acid residues that form the framework regions are disregarded. Such amino acid sequences of the invention can be as further described herein.

In such an amino acid sequence of the invention, the framework sequences may be any suitable framework sequences, and examples of suitable framework sequences will be clear to the skilled person, for example on the basis the standard handbooks and the further disclosure and prior art mentioned herein.

The framework sequences are preferably (a suitable combination of) immunoglobulin framework sequences or framework sequences that have been derived from immunoglobulin framework sequences (for example, by humanization or camelization). For example, the framework sequences may be framework sequences derived from a light chain variable domain (e.g. a $V_L$-sequence) and/or from a heavy chain variable domain (e.g. a $V_H$-sequence). In one particularly preferred aspect, the framework sequences are either framework sequences that have been derived from a $V_{HH}$-sequence (in which said framework sequences may optionally have been partially or fully humanized) or are conventional $V_H$ sequences that have been camelized (as defined herein).

The framework sequences are preferably such that the amino acid sequence of the invention is a domain antibody (or an amino acid sequence that is suitable for use as a domain antibody); is a single domain antibody (or an amino sequence that is suitable for use as a single domain antibody); is a "dAb" (or an amino acid sequence that is suitable for use as a dAb); or is a Nanobody® (including but not limited to $V_{HH}$ sequence). Again, suitable framework sequences will be clear to the skilled person, for example on the basis the standard handbooks and the further disclosure and prior art mentioned herein.

In particular, the framework sequences present in the amino acid sequences of the invention may contain one or more of Hallmark residues (as defined herein), such that the amino acid sequence of the invention is a Nanobody®. Some preferred, but non-limiting examples of (suitable combinations of) such framework sequences will become clear from the further disclosure herein.

Again, as generally described herein for the amino acid sequences of the invention, it is also possible to use suitable fragments (or combinations of fragments) of any of the foregoing, such as fragments that contain one or more CDR sequences, suitably flanked by and/or linked via one or more framework sequences (for example, in the same order as these CDR's and framework sequences may occur in the full-sized immunoglobulin sequence from which the fragment has been derived). Such fragments may also again be such that they comprise or can form an immunoglobulin fold, or alternatively be such that they do not comprise or cannot form an immunoglobulin fold.

In one specific aspect, such a fragment comprises a single CDR sequence as described herein (and in particular a CDR3 sequence), that is flanked on each side by (part of) a framework sequence (and in particular, part of the framework sequence(s) that, in the immunoglobulin sequence from which the fragment is derived, are adjacent to said CDR sequence. For example, a CDR3 sequence may be preceded by (part of) a FR3 sequence and followed by (part of) a FR4 sequence). Such a fragment may also contain a disulphide bridge, and in particular a disulphide bridge that links the two framework regions that precede and follow the CDR sequence, respectively (for the purpose of forming such a disulphide bridge, cysteine residues that naturally occur in said framework regions may be used, or alternatively cysteine residues may be synthetically added to or introduced into said framework regions). For a further description of these "Expedite fragments", reference is again made to WO 03/050531, as well as to as well as to the US provisional application of Ablynx N.V. entitled "Peptides capable of binding to serum proteins" of Ablynx N.V. (inventors: Revets, Hilde Adi Pierrette; Kolkman, Joost Alexander; and Hoogenboom, Hendricus Renerus Jacobus Mattheus) filed on Dec. 5, 2006 (see also PCT/EP2007/063348).

In another aspect, the invention relates to a compound or construct, and in particular a protein or polypeptide (also referred to herein as a "compound of the invention" or "polypeptide of the invention", respectively) that comprises or essentially consists of one or more amino acid sequences of the invention (or suitable fragments thereof), and optionally further comprises one or more other groups, residues, moieties or binding units. As will become clear to the skilled person from the further disclosure herein, such further groups, residues, moieties, binding units or amino acid sequences may or may not provide further functionality to the amino acid sequence of the invention (and/or to the compound or construct in which it is present) and may or may not modify the properties of the amino acid sequence of the invention.

For example, such further groups, residues, moieties or binding units may be one or more additional amino acid sequences, such that the compound or construct is a (fusion) protein or (fusion) polypeptide. In a preferred but non-limiting aspect, said one or more other groups, residues, moieties or binding units are immunoglobulin sequences. Even more preferably, said one or more other groups, residues, moieties or binding units are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies.

Alternatively, such groups, residues, moieties or binding units may for example be chemical groups, residues, moieties, which may or may not by themselves be biologically and/or pharmacologically active. For example, and without limitation, such groups may be linked to the one or more amino acid sequences of the invention so as to provide a "derivative" of an amino acid sequence or polypeptide of the invention, as further described herein.

Also within the scope of the present invention are compounds or constructs, that comprises or essentially consists of one or more derivatives as described herein, and optionally further comprises one or more other groups, residues, moieties or binding units, optionally linked via one or more linkers. Preferably, said one or more other groups, residues, moieties or binding units are amino acid sequences.

In the compounds or constructs described above, the one or more amino acid sequences of the invention and the one or more groups, residues, moieties or binding units may be linked directly to each other and/or via one or more suitable linkers or spacers. For example, when the one or more groups, residues, moieties or binding units are amino acid sequences, the linkers may also be amino acid sequences, so that the resulting compound or construct is a fusion (protein) or fusion (polypeptide).

The compounds or polypeptides of the invention can generally be prepared by a method which comprises at least one step of suitably linking the one or more amino acid sequences of the invention to the one or more further groups, residues, moieties or binding units, optionally via the one or more suitable linkers, so as to provide the compound or polypeptide of the invention. Polypeptides of the invention can also be prepared by a method which generally comprises at least the steps of providing a nucleic acid that encodes a polypeptide of the invention, expressing said nucleic acid in a suitable manner, and recovering the expressed polypeptide of the invention. Such methods can be performed in a manner known per se, which will be clear to the skilled person, for example on the basis of the methods and techniques further described herein.

The process of designing/selecting and/or preparing a compound or polypeptide of the invention, starting from an amino acid sequence of the invention, is also referred to herein as "formatting" said amino acid sequence of the invention; and an amino acid of the invention that is made part of a compound or polypeptide of the invention is said to be "formatted" or to be "in the format of" said compound or polypeptide of the invention. Examples of ways in which an amino acid sequence of the invention can be formatted and examples of such formats will be clear to the skilled person based on the disclosure herein; and such formatted amino acid sequences form a further aspect of the invention.

In one specific aspect of the invention, a compound of the invention or a polypeptide of the invention may have an increased half-life, compared to the corresponding amino acid sequence of the invention. Some preferred, but non-limiting examples of such compounds and polypeptides will become clear to the skilled person based on the further disclosure herein, and for example comprise amino acid sequences or polypeptides of the invention that have been chemically modified to increase the half-life thereof (for example, by means of pegylation); amino acid sequences of the invention that comprise at least one additional binding site for binding to a serum protein (such as serum albumin); or polypeptides of the invention that comprise at least one amino acid sequence of the invention that is linked to at least one moiety (and in particular at least one amino acid sequence) that increases the half-life of the amino acid sequence of the invention. Examples of polypeptides of the invention that comprise such half-life extending moieties or amino acid sequences will become clear to the skilled person based on the further disclosure herein; and for example include, without limitation, polypeptides in which the one or more amino acid sequences of the invention are suitable linked to one or more serum proteins or fragments thereof (such as (human) serum albumin or suitable fragments thereof) or to one or more binding units that can bind to serum proteins (such as, for example, domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies that can bind to serum proteins such as serum albumin (such as human serum albumin), serum immunoglobulins such as IgG, or transferrine; reference is made to the further description and references mentioned herein); polypeptides in which an amino acid sequence of the invention is linked to an Fc portion (such as a human Fc) or a suitable part or fragment thereof; or polypeptides in which the one or more amino acid sequences of the invention are suitable linked to one or more small proteins or peptides that can bind to serum proteins (such as, without limitation, the proteins and peptides described in WO 91/01743, WO 01/45746, WO 02/076489 and to the US provisional application of Ablynx N.V. entitled "Peptides capable of binding to serum proteins" of Ablynx N.V. filed on Dec. 5, 2006 (see also PCT/EP2007/063348).

Generally, the compounds or polypeptides of the invention with increased half-life preferably have a half-life that is at least 1.5 times, preferably at least 2 times, such as at least 5 times, for example at least 10 times or more than 20 times, greater than the half-life of the corresponding amino acid sequence of the invention per se. For example, the compounds or polypeptides of the invention with increased half-life may have a half-life that is increased with more than 1 hours, preferably more than 2 hours, more preferably more than 6 hours, such as more than 12 hours, or even more than 24, 48 or 72 hours, compared to the corresponding amino acid sequence of the invention per se.

In a preferred, but non-limiting aspect of the invention, such compounds or polypeptides of the invention have a serum half-life that is increased with more than 1 hours, preferably more than 2 hours, more preferably more than 6 hours, such as more than 12 hours, or even more than 24, 48 or 72 hours, compared to the corresponding amino acid sequence of the invention per se.

In another preferred, but non-limiting aspect of the invention, such compounds or polypeptides of the invention exhibit a serum half-life in human of at least about 12 hours, preferably at least 24 hours, more preferably at least 48 hours, even more preferably at least 72 hours or more. For example, compounds or polypeptides of the invention may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

In another aspect, the invention relates to a nucleic acid that encodes an amino acid sequence of the invention or a polypeptide of the invention (or a suitable fragment thereof). Such a nucleic acid will also be referred to herein as a "nucleic acid of the invention" and may for example be in the form of a genetic construct, as further described herein.

In another aspect, the invention relates to a host or host cell that expresses (or that under suitable circumstances is capable of expressing) an amino acid sequence of the invention and/or a polypeptide of the invention; and/or that contains a nucleic acid of the invention. Some preferred but non-limiting examples of such hosts or host cells will become clear from the further description herein.

The invention also relates to the use of an amino acid sequence, Nanobody or polypeptide of the invention, or of a composition comprising the same, in (methods or compositions for) modulating an APC target or a T-cell target, in particular, targets that belong to the B7:CD28 superfamily (such as B7-1, B7-2, B7RP-1, PD-L1, PD-L2, B7H-3 and B7x ["APC targets"] and their receptors CD28, CTLA-4, ICOS, PD-1, BTLA and TIM-3 ["T-cell targets"]), either in vitro (e.g. in an in vitro or cellular assay) or in vivo (e.g. in an a single cell or in a multicellular organism, and in particular in a mammal, and more in particular in a human being, such as in a human being that is at risk of or suffers from a cancers and/or tumors).

The invention also relates to methods for modulating an APC target or a T-cell target, in particular, a target that belong to the B7:CD28 superfamily (such as B7-1, B7-2, B7RP-1, PD-L1, PD-L2, B7H-3 and B7x ["APC targets"] and their receptors CD28, CTLA-4, ICOS, PD-1, BTLA and TIM-3 ["T-cell targets"]), either in vitro (e.g. in an in vitro or cellular assay) or in vivo (e.g. in an a single cell or multicellular organism, and in particular in a mammal, and more in particular in a human being, such as in a human being that is at risk of or suffers from a cancer and/or tumor), which method comprises at least the step of contacting the APC target or T-cell target, in particular, a target that belong to the B7:CD28 superfamily (such as B7-1, B7-2, B7RP-1, PD-L1, PD-L2, B7H-3 and B7x ["APC targets"] and their receptors CD28, CTLA-4, ICOS, PD-1, BTLA and TIM-3 ["T-cell targets"]), with at least one amino acid sequence, Nanobody or polypeptide of the invention, or with a composition comprising the same, in a manner and in an amount suitable to modulate the APC target or T-cell target, in particular, a target that belong to the B7:CD28 superfamily (such as B7-1, B7-2, B7RP-1, PD-L1, PD-L2, B7H-3 and B7x ["APC targets"] and their receptors CD28, CTLA-4, ICOS, PD-1, BTLA and TIM-3 ["T-cell targets"]), with at least one amino acid sequence, Nanobody or polypeptide of the invention.

The invention also relates to the use of an one amino acid sequence, Nanobody or polypeptide of the invention in the preparation of a composition (such as, without limitation, a pharmaceutical composition or preparation as further described herein) for modulating an APC target or a T-cell target, in particular, a target that belong to the B7:CD28 superfamily (such as B7-1, B7-2, B7RP-1, PD-L1, PD-L2, B7H-3 and B7x ["APC targets"] and their receptors CD28, CTLA-4, ICOS, PD-1, BTLA and TIM-3 ["T-cell targets"]), either in vitro (e.g. in an in vitro or cellular assay) or in vivo (e.g. in an a single cell or multicellular organism, and in particular in a mammal, and more in particular in a human being, such as in a human being that is at risk of or suffers from a cancer and/or tumor).

In the context of the present invention, "modulating" or "to modulate" generally means either reducing or inhibiting the activity of, or alternatively increasing the activity of, the APC target or T-cell target, in particular, a target that belong to the B7:CD28 superfamily (such as B7-1, B7-2, B7RP-1, PD-L1, PD-L2, B7H-3 and B7x ["APC targets"] and their receptors CD28, CTLA-4, ICOS, PD-1, BTLA and TIM-3 ["T-cell targets"]), as measured using a suitable in vitro, cellular or in vivo assay (such as those mentioned herein). In particular, "modulating" or "to modulate" may mean either reducing or inhibiting the activity of, or alternatively increasing the activity of the APC target or T-cell target, in particular, a target that belong to the B7:CD28 superfamily (such as B7-1, B7-2, B7RP-1, PD-L1, PD-L2, B7H-3 and B7x ["APC targets"] and their receptors CD28, CTLA-4, ICOS, PD-1, BTLA and TIM-3 ["T-cell targets"]), as measured using a suitable in vitro, cellular or in vivo assay (such as those mentioned herein), by at least 1%, preferably at least 5%, such as at least 10% or at least 25%, for example by at least 50%, at least 60%, at least 70%, at least 80%, or 90% or more, compared to activity of the APC target or T-cell target, in particular, a target that belong to the B7:CD28 superfamily (such as B7-1, B7-2, B7RP-1, PD-L1, PD-L2, B7H-3 and B7x ["APC targets"] and their receptors CD28, CTLA-4, ICOS, PD-1, BTLA and TIM-3 ["T-cell targets"]), in the same assay under the same conditions but without the presence of the amino acid sequence, Nanobody or polypeptide of the invention.

As will be clear to the skilled person, "modulating" may also involve effecting a change (which may either be an increase or a decrease) in affinity, avidity, specificity and/or selectivity of the APC target or T-cell target, in particular, a target that belong to the B7:CD28 superfamily (such as B7-1, B7-2, B7RP-1, PD-L1, PD-L2, B7H-3 and B7x ["APC targets"] and their receptors CD28, CTLA-4, ICOS, PD-1, BTLA and TIM-3 ["T-cell targets"]), for one or more of its targets, ligands, receptors or substrates; and/or effecting a change (which may either be an increase or a decrease) in the sensitivity of the APC target or T-cell target, in particular, a target that belong to the B7:CD28 superfamily (such as B7-1, B7-2, B7RP-1, PD-L1, PD-L2, B7H-3 and B7x ["APC targets"] and their receptors CD28, CTLA-4, ICOS, PD-1, BTLA and TIM-3 ["T-cell targets"]), for one or more conditions in the medium or surroundings in which the APC target or T-cell target, in particular, a target that belong to the B7:CD28 superfamily (such as B7-1, B7-2, B7RP-1, PD-L1, PD-L2, B7H-3 and B7x ["APC targets"] and their receptors CD28, CTLA-4, ICOS, PD-1, BTLA and TIM-3 ["T-cell targets"]), is present (such as pH, ion strength, the presence of co-factors, etc.), compared to the same conditions but without the presence of the amino acid sequence, Nanobody or polypeptide of the invention. As will be clear to the skilled person, this may again be determined in any suitable manner and/or using any suitable assay known per se, such as the assays described herein or in the prior art cited herein.

"Modulating" may also mean effecting a change (i.e. an activity as an agonist or as an antagonist, respectively) with respect to one or more biological or physiological mechanisms, effects, responses, functions, pathways or activities in which the APC target or T-cell target, in particular, a target that belong to the B7:CD28 superfamily (such as B7-1, B7-2, B7RP-1, PD-L1, PD-L2, B7H-3 and B7x ["APC targets"] and their receptors CD28, CTLA-4, ICOS, PD-1, BTLA and TIM-3 ["T-cell targets"]), (or in which its substrate(s), ligand(s), receptor(s) or pathway(s) are involved, such as its signalling pathway or metabolic pathway and their associated biological or physiological effects) is involved. Again, as will be clear to the skilled person, such an action as an agonist or an antagonist may be determined in any suitable manner and/or using any suitable (in vitro and usually cellular or in assay) assay known per se, such as the assays described herein or in the prior art cited herein. In particular, an action as an agonist or antagonist may be such that an intended biological or physiological activity is increased or decreased, respectively, by at least 1%, preferably at least 5%, such as at least 10% or at least 25%, for example by at least 50%, at least 60%, at least 70%, at least 80%, or 90% or more, compared to the biological or physiological activity in the same assay under the same conditions but without the presence of the amino acid sequence, Nanobody or polypeptide of the invention.

Modulating may for example involve reducing or inhibiting the binding of the APC target or T-cell target, in particular, a target that belong to the B7:CD28 superfamily (such as B7-1, B7-2, B7RP-1, PD-L1, PD-L2, B7H-3 and B7x ["APC targets"] and their receptors CD28, CTLA-4, ICOS, PD-1, BTLA and TIM-3 ["T-cell targets"]) to one of its substrates, receptor(s) or ligands and/or competing with a natural ligand, receptor or substrate for binding to the APC target or T-cell target, in particular, a target that belong to the B7:CD28 superfamily (such as B7-1, B7-2, B7RP-1, PD-L1, PD-L2, B7H-3 and B7x ["APC targets"] and their receptors CD28, CTLA-4, ICOS, PD-1, BTLA and TIM-3 ["T-cell targets"]). Modulating may also involve activating the APC target or T-cell target, in particular, targets that belong to the B7:CD28 superfamily (such as B7-1, B7-2, B7RP-1, PD-L1, PD-L2, B7H-3 and B7x ["APC targets"] and their receptors CD28, CTLA-4, ICOS, PD-1, BTLA and TIM-3 ["T-cell targets"]), or the mechanism or pathway in which it is involved. Modulating may be reversible or irreversible, but for pharmaceutical and pharmacological purposes will usually be in a reversible manner. Modulating may for example also involve reducing or inhibiting the binding of the APC target to one of its T-cell target receptors and/or competing with one of its T-cell target receptors for binding to the APC target. Modulating may also involve reducing or inhibiting the binding of the T-cell target to one of its APC target receptors and/or competing with one of its APC target receptors for binding to the T-cell target.

Without being limiting, in one aspect, the amino acid sequence, Nanobody or polypeptide of the invention or the composition comprising the same will inhibit and/or block binding of B7-1 to CD28. The amino acid sequence, Nanobody or polypeptide of the invention or the composition comprising the same will preferably inhibit binding of B7-1 to CD28 by at least 1%, preferably at least 5%, such as at least 10%, for example 25% or more or even 50% or more and up to 75% or even more than 90% or more, compared to binding of B7-1 to CD28 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7-1 to CTLA4. The amino acid sequence, Nanobody or polypeptide of the invention or the composition comprising the same will preferably inhibit binding of B7-1 to CTLA4 by at least 1%, preferably at least 5%, such as at least 10%, for example 25% or more or even 50% or more and up to 75% or even more than 90% or more, compared to binding of B7-1 to CTLA4 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7-1 to CTLA4 and binding of B7-1 to CD28. The amino acid sequence, Nanobody or polypeptide of the invention or the composition comprising the same will preferably inhibit binding of B7-1 to CTLA4 and binding of B7-1 to CD28 by at least 1%, preferably at least 5%, such as at least 10%, for example 25% or more or even 50% or more and up to 75% or even more than 90% or more, compared to respectively binding of B7-1 to CTLA4 and binding of B7-1 to CD28 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7-1 to CD28 while the binding of B7-1 to CTLA4 is not inhibited and/or blocked. The amino acid sequence, Nanobody or polypeptide of the invention or the composition comprising the same will preferably inhibit binding of B7-1 to CD28 by at least 1%, preferably at least 5%, such as at least 10%, for example 25% or more or even 50% or more and up to 75% or even more than 90% or more, compared to binding of B7-1 to CD28 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7-1 to CTLA4 while the binding of B7-1 to CD28 is not inhibited and/or blocked. The amino acid sequence, Nanobody or polypeptide of the invention or the composition comprising the same will preferably inhibit binding of B7-1 to CTLA4 by at least 1%, preferably at least 5%, such as at least 10%, for example 25% or more or even 50% or more and up to 75% or even more than 90% or more, compared to binding of B7-1 to CTLA4 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7-2 to CD28. The amino acid sequence, Nanobody or polypeptide of the invention or the composition comprising the same will preferably inhibit binding of B7-2 to CD28 by at least 1%, preferably at least 5%, such as at least 10%, for example 25% or more or even 50% or more and up to 75% or even more than 90% or more, compared to binding of B7-2 to CD28 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7-2 to CTLA4. The amino acid sequence, Nanobody or polypeptide of the invention or the composition comprising the same will preferably inhibit binding of B7-2 to CTLA4 by at least 1%, preferably at least 5%, such as at least 10%, for example 25% or more or even 50% or more and up to 75% or even more than 90% or more, compared to binding of B7-2 to CTLA4 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7-2 to CTLA4 and binding of B7-2 to CD28. The amino acid sequence, Nanobody or polypeptide of the invention or the composition comprising the same will preferably inhibit binding of B7-2 to CTLA4 and binding of B7-2 to CD28 by at least 1%, preferably at least 5%, such as at least 10%, for example 25% or more or even 50% or more and up to 75% or even more than 90% or more, compared to binding of respectively B7-2 to CTLA4 and binding of B7-2 to CD28 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7-2 to CD28 while the binding of B7-2 to CTLA4 is not inhibited and/or blocked. The amino acid sequence, Nanobody or polypeptide of the invention or the composition comprising the same will preferably inhibit binding of B7-2 to CD28 by at least 1%, preferably at least 5%, such as at least 10%, for example 25% or more or even 50% or more and up to 75% or even more than 90% or more, compared to binding of B7-2 to CD28 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7-2 to CTLA4 while the binding of B7-2 to CD28 is not inhibited and/or blocked. The amino acid sequence, Nanobody or polypeptide of the invention or the composition comprising the same will preferably inhibit binding of B7-2 to CTLA4 by at least 1%, preferably at least 5%, such as at least 10%, for example 25% or more or even 50% or more and up to 75% or even more than 90% or more, compared to binding of B7-2 to CTLA4 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7-1 to CD28 and binding of B7-2 to CD28. The amino acid sequence, Nanobody or polypeptide of the invention or the composition comprising the same will preferably inhibit binding of B7-1 to CD28 and binding of B7-2 to CD28 by at least 1%, preferably at least 5%, such as at least 10%, for example 25% or more or even 50% or more and up to 75% or even more than 90% or more, compared to respectively binding of B7-12 to CD28 and binding of B7-1 to CD28 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7-1 to CD28 while the binding of B7-2 to CD28 is not inhibited and/or blocked. The amino acid sequence, Nanobody or polypeptide of the invention or the composition comprising the same will preferably inhibit binding of B7-1 to CD28 by at least 1%, preferably at least 5%, such as at least 10%, for example 25% or more or even 50% or more and up to 75% or even more than 90% or more, compared to binding of B7-1 to CD28 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7-2 to CD28 while the binding of B7-1 to CD28 is not inhibited and/or blocked. The amino acid sequence, Nanobody or polypeptide of the invention or the composition comprising the same will preferably inhibit binding of B7-2 to CD28 by at least 1%, preferably at least 5%, such as at least 10%, for example 25% or more or even 50% or more and up to 75% or even more than 90% or more, compared to binding of B7-2 to CD28 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7-1 to CTLA4 and binding of B7-2 to CTLA4. The amino acid sequence, Nanobody or polypeptide of the invention or the composition comprising the same will preferably inhibit binding of B7-1 to CTLA4 and binding of B7-2 to CTLA4 by at least 1%, preferably at least 5%, such as at least 10%, for example 25% or more or even 50% or more and up to 75% or even more than 90% or more, compared to respectively binding of B7-1 to CTLA4 and binding of B7-2 to CTLA4 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7-1 to CTLA4 while the binding of B7-2 to CTLA4 is not inhibited and/or blocked. The amino acid sequence, Nanobody or polypeptide of the invention or the composition comprising the same will preferably inhibit binding of B7-1 to CTLA4 by at least 1%, preferably at least 5%, such as at least 10%, for example 25% or more or even 50% or more and up to 75% or even more than 90% or more, compared to binding of B7-1 to CTLA4 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7-2 to CTLA4 while the binding of B7-1 to CTLA4 is not inhibited and/or blocked. The amino acid sequence, Nanobody or polypeptide of the invention or the composition comprising the same will preferably inhibit binding of B7-2 to CTLA4 by at least 1%, preferably at least 5%, such as at least 10%, for example 25% or more or even 50% or more and up to 75% or even more than 90% or more, compared to binding of B7-2 to CTLA4 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7RP-1 to ICOS. The amino acid sequence, Nanobody or polypeptide of the invention or the composition comprising the same will preferably inhibit binding of B7RP-1 to ICOS by at least 1%, preferably at least 5%, such as at least 10%, for example 25% or more or even 50% or more and up to 75% or even more than 90% or more, compared to binding of B7RP-1 to ICOS in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of PD-L1 to PD-1. The amino acid sequence, Nanobody or polypeptide of the invention or the composition comprising the same will preferably inhibit binding of PD-L1 to PD-1 by at least 1%, preferably at least 5%, such as at least 10%, for example 25% or more or even 50% or more and up to 75% or even more than 90% or more, compared to binding of PD-L1 to PD-1 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of PD-L2 to PD-1. The amino acid sequence, Nanobody or polypeptide of the invention or the composition comprising the same will preferably inhibit binding of PD-L2 to PD-1 by at least 1%, preferably at least 5%, such as at least 10%, for example 25% or more or even 50% or more and up to 75% or even more than 90% or more, compared to binding of PD-L2 to PD-1 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of PD-L1 to PD-1 and binding of PD-L2 to PD-1. The amino acid sequence, Nanobody or polypeptide of the invention or the composition comprising the same will preferably inhibit binding of PD-L1 to PD-1 and binding of PD-L2 to PD-1 by at least 1%, preferably at least 5%, such as at least 10%, for example 25% or more or even 50% or more and up to 75% or even more than 90% or more, compared to respectively binding of PD-L1 to PD-1 and binding of PD-L2 to PD-1 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of PD-L1 to PD-1 while the binding of PD-L2 to PD-1 is not inhibited and/or blocked. The amino acid sequence, Nanobody or polypeptide of the invention or the composition comprising the same will preferably inhibit binding of PD-L1 to PD-1 by at least 1%, preferably at least 5%, such as at least 10%, for example 25% or more or even 50% or more and up to 75% or even more than 90% or more, compared to binding of PD-L1 to PD-1 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of PD-L2 to PD-1 while the binding of PD-L1 to PD-1 is not inhibited and/or blocked. The amino acid sequence, Nanobody or polypeptide of the invention or the composition comprising the same will preferably inhibit binding of PD-L2 to PD-1 by at least 1%, preferably at least 5%, such as at least 10%, for example 25% or more or even 50% or more and up to 75% or even more than 90% or more, compared to binding of PD-L2 to PD-1 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7H-3 to BTLA. The amino acid sequence, Nanobody or polypeptide of the invention or the composition comprising the same will preferably inhibit binding of B7H-3 to BTLA by at least 1%, preferably at least 5%, such as at least 10%, for example 25% or more or even 50% or more and up to 75% or even more than 90% or more, compared to binding of B7H-3 to BTLA in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7x to BTLA. The amino acid sequence, Nanobody or polypeptide of the invention or the composition comprising the same will preferably inhibit binding of B7x to BTLA by at least 1%, preferably at least 5%, such as at least 10%, for example 25% or more or even 50% or more and up to 75% or even more than 90% or more, compared to binding of B7x to BTLA in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7H-3 to BTLA and binding of B7x to BTLA. The amino acid sequence, Nanobody or polypeptide of the invention or the composition comprising the same will preferably inhibit binding of B7H-3 to BTLA and binding of B7x to BTLA by at least 1%, preferably at least 5%, such as at least 10%, for example 25% or more or even 50% or more and up to 75% or even more than 90% or more, compared to respectively binding of B7H-3 to BTLA and binding of B7x to BTLA in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7H-3 to BTLA while the binding of B7x to BTLA is not inhibited and/or blocked. The amino acid sequence, Nanobody or polypeptide of the invention or the composition comprising the same will preferably inhibit binding of B7H-3 to BTLA by at least 1%, preferably at least 5%, such as at least 10%, for example 25% or more or even 50% or more and up to 75% or even more than 90% or more, compared to binding of B7H-3 to BTLA in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of B7x to BTLA while the binding of B7H-3 to BTLA is not inhibited and/or blocked. The amino acid sequence, Nanobody or polypeptide of the invention or the composition comprising the same will preferably inhibit binding of B7x to BTLA by at least 1%, preferably at least 5%, such as at least 10%, for example 25% or more or even 50% or more and up to 75% or even more than 90% or more, compared to binding of B7x to BTLA in the absence of the amino acid sequence, Nanobody or polypeptide of the invention or the composition comprising the same.

In another aspect, the amino acid sequence, Nanobody or polypeptide of the invention or the composition comprising the same will inhibit and/or block T-cell activation. The amino acid sequence, Nanobody or polypeptide of the invention or the composition comprising the same will preferably inhibit T-cell activation by at least 1%, preferably at least 5%, such as at least 10%, for example 25% or more or even 50% or more and up to 75% or even more than 90% or more, compared to the T-cell activation in the absence of the amino acid sequence, Nanobody or polypeptide of the invention or the composition comprising the same.

In another aspect, the amino acid sequence, Nanobody or polypeptide of the invention or the composition comprising the same will promote and/or increase T-cell activation. The amino acid sequence, Nanobody or polypeptide of the invention or the composition comprising the same will preferably promote and/or increase T-cell activation by at least 1%, preferably at least 5%, such as at least 10%, for example 25% or more or even 50% or more and up to 75% or even more than 90% or more, compared to the T-cell activation in the absence of the amino acid sequence, Nanobody or polypeptide of the invention or the composition comprising the same. For example, an amino acid sequence, Nanobody or polypeptide of the invention or the composition comprising the same may be directed against CTLA4 and increase T-cell activation by at least 1%, preferably at least 5%, such as at least 10%, for example 25% or more or even 50% or more and up to 75% or even more than 90% or more, compared to the T-cell activation in the absence of said amino acid sequence, Nanobody or polypeptide of the invention or the composition comprising the same.

In another aspect, the amino acid sequence, Nanobody or polypeptide of the invention or the composition comprising the same will suppress, decrease, inhibit and/or block cytokine (such as e.g. IL-10, IFNgamma) production. The amino acid sequence, Nanobody or polypeptide of the invention or the composition comprising the same will preferably suppress, decrease and/or inhibit cytokine (such as e.g. IL-10, IFNgamma) production by at least 1%, preferably at least 5%, such as at least 10%, for example 25% or more or even 50% or more and up to 75% or even more than 90% or more, compared to the cytokine (such as e.g. IL-10, IFNgamma) production in the absence of the amino acid sequence, Nanobody or polypeptide of the invention or the composition comprising the same.

In another aspect, the amino acid sequence, Nanobody or polypeptide of the invention or the composition comprising the same will increase cytokine (such as e.g. IL-10, IFNgamma) production. The amino acid sequence, Nanobody or polypeptide of the invention or the composition comprising the same will preferably increase cytokine (such as e.g. IL-10, IFNgamma) production by at least 1%, preferably at least 5%, such as at least 10%, for example 25% or more or even 50% or more and up to 75% or even more than 90% or more, compared to the cytokine (such as e.g. IL-10, IFNgamma) production in the absence of the amino acid sequence, Nanobody or polypeptide of the invention or the composition comprising the same.

In another aspect, the amino acid sequence, Nanobody or polypeptide of the invention or the composition comprising the same will increase T-cell survival. The amino acid sequence, Nanobody or polypeptide of the invention or the composition comprising the same will preferably increase T-cell survival by at least 1%, preferably at least 5%, such as at least 10%, for example 25% or more or even 50% or more and up to 75% or even more than 90% or more, compared to the T-cell survival in the absence of the amino acid sequence, Nanobody or polypeptide of the invention or the composition comprising the same.

In another aspect, the amino acid sequence, Nanobody or polypeptide of the invention or the composition comprising the same will decrease T-cell survival. The amino acid sequence, Nanobody or polypeptide of the invention or the composition comprising the same will preferably decrease T-cell survival by at least 1%, preferably at least 5%, such as at least 10%, for example 25% or more or even 50% or more and up to 75% or even more than 90% or more, compared to the T-cell survival in the absence of the amino acid sequence, Nanobody or polypeptide of the invention or the composition comprising the same.

In another aspect, the amino acid sequence, Nanobody or polypeptide of the invention or the composition comprising the same will increase differentiation of naïve T-cells into activated cytokine secreting T-cells. The amino acid sequence, Nanobody or polypeptide of the invention or the composition comprising the same will preferably increase differentiation of naïve T-cells into activated cytokine secreting T-cells by at least 1%, preferably at least 5%, such as at least 10%, for example 25% or more or even 50% or more and up to 75% or even more than 90% or more, compared to the differentiation of naïve T-cells into activated cytokine secreting T-cells in the absence of the amino acid sequence, Nanobody or polypeptide of the invention or the composition comprising the same.

In another aspect, the amino acid sequence, Nanobody or polypeptide of the invention or the composition comprising the same will decrease differentiation of naïve T-cells into activated cytokine secreting T-cells. The amino acid sequence, Nanobody or polypeptide of the invention or the composition comprising the same will preferably decrease differentiation of naïve T-cells into activated cytokine secreting T-cells by at least 1%, preferably at least 5%, such as at least 10%, for example 25% or more or even 50% or more and up to 75% or even more than 90% or more, compared to the differentiation of naïve T-cells into activated cytokine secreting T-cells in the absence of the amino acid sequence, Nanobody or polypeptide of the invention or the composition comprising the same.

The invention further relates to a product or composition containing or comprising at least one amino acid sequence of the invention, at least one polypeptide of the invention (or a suitable fragment thereof) and/or at least one nucleic acid of the invention, and optionally one or more further components of such compositions known per se, i.e. depending on the intended use of the composition. Such a product or composition may for example be a pharmaceutical composition (as described herein), a veterinary composition or a product or composition for diagnostic use (as also described herein). Some preferred but non-limiting examples of such products or compositions will become clear from the further description herein.

The invention further relates to methods for preparing or generating the amino acid sequences, polypeptides, nucleic acids, host cells, products and compositions described herein. Some preferred but non-limiting examples of such methods will become clear from the further description herein.

Generally, these methods may comprise the steps of:
a) providing a set, collection or library of amino acid sequences; and
b) screening said set, collection or library of amino acid sequences for amino acid sequences that can bind to and/or have affinity for an APC target or a T-cell target; and
c) isolating the amino acid sequence(s) that can bind to and/or have affinity for said APC target or said T-cell target.

In such a method, the set, collection or library of amino acid sequences may be any suitable set, collection or library of amino acid sequences. For example, the set, collection or library of amino acid sequences may be a set, collection or library of immunoglobulin sequences (as described herein), such as a naïve set, collection or library of immunoglobulin sequences; a synthetic or semi-synthetic set, collection or library of immunoglobulin sequences; and/or a set, collection or library of immunoglobulin sequences that have been subjected to affinity maturation.

Also, in such a method, the set, collection or library of amino acid sequences may be a set, collection or library of heavy chain variable domains (such as $V_H$ domains or $V_{HH}$ domains) or of light chain variable domains. For example, the set, collection or library of amino acid sequences may be a set, collection or library of domain antibodies or single domain antibodies, or may be a set, collection or library of amino acid sequences that are capable of functioning as a domain antibody or single domain antibody.

In a preferred aspect of this method, the set, collection or library of amino acid sequences may be an immune set, collection or library of immunoglobulin sequences, for example derived from a mammal that has been suitably immunized with an APC target or a T-cell target or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

In the above methods, the set, collection or library of amino acid sequences may be displayed on a phage, phagemid, ribosome or suitable micro-organism (such as yeast), such as to facilitate screening. Suitable methods, techniques and host organisms for displaying and screening (a set, collection or library of) amino acid sequences will be clear to the person skilled in the art, for example on the basis of the further disclosure herein. Reference is also made to the review by Hoogenboom in Nature Biotechnology, 23, 9, 1105-1116 (2005).

In another aspect, the method for generating amino acid sequences comprises at least the steps of:
a) providing a collection or sample of cells expressing amino acid sequences;
b) screening said collection or sample of cells for cells that express an amino acid sequence that can bind to and/or have affinity for an APC target or a T-cell target; and
c) either (i) isolating said amino acid sequence; or (ii) isolating from said cell a nucleic acid sequence that encodes said amino acid sequence, followed by expressing said amino acid sequence.

For example, when the desired amino acid sequence is an immunoglobulin sequence, the collection or sample of cells may for example be a collection or sample of B-cells. Also, in this method, the sample of cells may be derived from a mammal that has been suitably immunized with the APC target or T-cell target or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The above method may be performed in any suitable manner, as will be clear to the skilled person. Reference is for example made to EP 0 542 810, WO 05/19824, WO 04/051268 and WO 04/106377. The screening of step b) is preferably performed using a flow cytometry technique such as FACS. For this, reference is for example made to Lieby et al., Blood, Vol. 97, No. 12, 3820 (2001).

In another aspect, the method for generating an amino acid sequence directed against an APC target or a T-cell target may comprise at least the steps of:
a) providing a set, collection or library of nucleic acid sequences encoding amino acid sequences;
b) screening said set, collection or library of nucleic acid sequences for nucleic acid sequences that encode an amino acid sequence that can bind to and/or has affinity for an APC target or a T-cell target; and
c) isolating said nucleic acid sequence, followed by expressing said amino acid sequence.

In such a method, the set, collection or library of nucleic acid sequences encoding amino acid sequences may for example be a set, collection or library of nucleic acid sequences encoding a naïve set, collection or library of immunoglobulin sequences; a set, collection or library of nucleic acid sequences encoding a synthetic or semi-synthetic set, collection or library of immunoglobulin sequences; and/or a set, collection or library of nucleic acid sequences encoding a set, collection or library of immunoglobulin sequences that have been subjected to affinity maturation.

Also, in such a method, the set, collection or library of nucleic acid sequences may encode a set, collection or library of heavy chain variable domains (such as $V_H$ domains or $V_{HH}$ domains) or of light chain variable domains. For example, the set, collection or library of nucleic acid sequences may encode a set, collection or library of domain antibodies or single domain antibodies, or a set, collection or library of amino acid sequences that are capable of functioning as a domain antibody or single domain antibody.

In a preferred aspect of this method, the set, collection or library of amino acid sequences may be an immune set, collection or library of nucleic acid sequences, for example derived from a mammal that has been suitably immunized with an APC target or a T-cell target or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The set, collection or library of nucleic acid sequences may for example encode an immune set, collection or library of heavy chain variable domains or of light chain variable domains. In one specific aspect, the set, collection or library of nucleotide sequences may encode a set, collection or library of $V_{HH}$ sequences.

In the above methods, the set, collection or library of nucleotide sequences may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to the review by Hoogenboom in Nature Biotechnology, 23, 9, 1105-1116 (2005).

The invention also relates to amino acid sequences that are obtained by the above methods, or alternatively by a method that comprises the one of the above methods and in addition at least the steps of determining the nucleotide sequence or amino acid sequence of said immunoglobulin sequence; and of expressing or synthesizing said amino acid sequence in a manner known per se, such as by expression in a suitable host cell or host organism or by chemical synthesis.

Also, following the steps above, one or more amino acid sequences of the invention may be suitably humanized (or alternatively camelized); and/or the amino acid sequence(s) thus obtained may be linked to each other or to one or more other suitable amino acid sequences (optionally via one or more suitable linkers) so as to provide a polypeptide of the invention. Also, a nucleic acid sequence encoding an amino acid sequence of the invention may be suitably humanized (or alternatively camelized) and suitably expressed; and/or one or more nucleic acid sequences encoding an amino acid sequence of the invention may be linked to each other or to one or more nucleic acid sequences that encode other suitable amino acid sequences (optionally via nucleotide sequences that encode one or more suitable linkers), after which the nucleotide sequence thus obtained may be suitably expressed so as to provide a polypeptide of the invention.

The invention further relates to applications and uses of the amino acid sequences, compounds, constructs, polypeptides, nucleic acids, host cells, products and compositions described herein, as well as to methods for the prevention and/or treatment for diseases and disorders associated with an APC target or a T-cell target. Some preferred but non-limiting applications and uses will become clear from the further description herein.

The invention also relates to the amino acid sequences, compounds, constructs, polypeptides, nucleic acids, host cells, products and compositions described herein for use in therapy.

In particular, the invention also relates to the amino acid sequences, compounds, constructs, polypeptides, nucleic acids, host cells, products and compositions described herein for use in therapy of a disease or disorder that can be prevented or treated by administering, to a subject in need thereof, of (a pharmaceutically effective amount of) an amino acid sequence, compound, construct or polypeptide as described herein.

More in particular, the invention relates to the amino acid sequences, compounds, constructs, polypeptides, nucleic acids, host cells, products and compositions described herein for use in therapy of autoimmune diseases, allergy and asthma, transplant rejections (acute and chronic), cancer and tumors, effector cell exhaustion and infections.

Other aspects, embodiments, advantages and applications of the invention will also become clear from the further description herein, in which the invention will be described and discussed in more detail with reference to the Nanobodies of the invention and polypeptides of the invention comprising the same, which form some of the preferred aspects of the invention.

As will become clear from the further description herein, Nanobodies generally offer certain advantages (outlined herein) compared to "dAb's" or similar (single) domain antibodies or immunoglobulin sequences, which advantages are also provided by the Nanobodies of the invention. However, it will be clear to the skilled person that the more general aspects of the teaching below can also be applied (either directly or analogously) to other amino acid sequences of the invention.

DETAILED DESCRIPTION OF THE INVENTION

In the present description, examples and claims:

a) Unless indicated or defined otherwise, all terms used have their usual meaning in the art, which will be clear to the skilled person. Reference is for example made to the standard handbooks, such as Sambrook et al, "Molecular Cloning: A Laboratory Manual" (2nd. Ed.), Vols. 1-3, Cold Spring Harbor Laboratory Press (1989); F. Ausubel et al, eds., "Current protocols in molecular biology", Green Publishing and Wiley Interscience, New York (1987); Lewin, "Genes II", John Wiley & Sons, New York, N.Y., (1985); Old et al., "Principles of Gene Manipulation: An Introduction to Genetic Engineering", 2nd edition, University of California Press, Berkeley, Calif. (1981); Roitt et al., "Immunology" (6th. Ed.), Mosby/Elsevier, Edinburgh (2001); Roitt et al., Roitt's Essential Immunology, $10^{th}$ Ed. Blackwell Publishing, UK (2001); and Janeway et al., "Immunobiology" (6th Ed.), Garland Science Publishing/Churchill Livingstone, New York (2005), as well as to the general background art cited herein;

b) Unless indicated otherwise, the term "immunoglobulin sequence"—whether used herein to refer to a heavy chain antibody or to a conventional 4-chain antibody—is used as a general term to include both the full-size antibody, the individual chains thereof, as well as all parts, domains or fragments thereof (including but not limited to antigen-binding domains or fragments such as $V_{HH}$ domains or $V_H/V_L$ domains, respectively). In addition, the term "sequence" as used herein (for example in terms like "immunoglobulin sequence", "antibody sequence", "variable domain sequence", "$V_{HH}$ sequence" or "protein sequence"), should generally be understood to include both the relevant amino acid sequence as well as nucleic acids or nucleotide sequences encoding the same, unless the context requires a more limited interpretation. Also, the term "nucleotide sequence" as used herein also encompasses a nucleic acid molecule with said nucleotide sequence, so that the terms "nucleotide sequence" and "nucleic acid" should be considered equivalent and are used interchangeably herein;

c) Unless indicated otherwise, all methods, steps, techniques and manipulations that are not specifically described in detail can be performed and have been performed in a manner known per se, as will be clear to the skilled person. Reference is for example again made to the standard handbooks and the general background art mentioned herein and to the further references cited therein; as well as to for example the following reviews Presta, Adv. Drug Deliv. Rev. 2006, 58 (5-6): 640-56; Levin and Weiss, Mol. Biosyst. 2006, 2(1): 49-57; Irving et al., J. Immunol. Methods, 2001, 248(1-2), 31-45; Schmitz et al., Placenta, 2000, 21 Suppl. A, S106-12, Gonzales et al., Tumour Biol., 2005, 26(1), 31-43, which describe techniques for protein engineering, such as affinity maturation and other techniques for improving the specificity and other desired properties of proteins such as immunoglobulins.

d) Amino acid residues will be indicated according to the standard three-letter or one-letter amino acid code, as mentioned in Table A-2;

TABLE A-2 one-letter and three-letter amino acid code

| | | | |
|---|---|---|---|
| Nonpolar, uncharged (at pH 6.0-7.0)[3] | Alanine | Ala | A |
| | Valine | Val | V |
| | Leucine | Leu | L |
| | Isoleucine | Ile | I |
| | Phenylalanine | Phe | F |
| | Methionine[1] | Met | M |
| | Tryptophan | Trp | W |
| | Proline | Pro | P |
| Polar, uncharged (at pH 6.0-7.0) | Glycine[2] | Gly | G |
| | Serine | Ser | S |
| | Threonine | Thr | T |
| | Cysteine | Cys | C |
| | Asparagine | Asn | N |
| | Glutamine | Gln | Q |
| | Tyrosine | Tyr | Y |
| Polar, charged (at pH 6.0-7.0) | Lysine | Lys | K |
| | Arginine | Arg | R |
| | Histidine[4] | His | H |
| | Aspartate | Asp | D |
| | Glutamate | Glu | E |

Notes:
[1]Sometimes also considered to be a polar uncharged amino acid.
[2]Sometimes also considered to be a nonpolar uncharged amino acid.
[3]As will be clear to the skilled person, the fact that an amino acid residue is referred to in this Table as being either charged or uncharged at pH 6.0 to 7.0 does not reflect in any way on the charge said amino acid residue may have at a pH lower than 6.0 and/or at a pH higher than 7.0; the amino acid residues mentioned in the Table can be either charged and/or uncharged at such a higher or lower pH, as will be clear to the skilled person.
[4]As is known in the art, the charge of a His residue is greatly dependant upon even small shifts in pH, but a His residu can generally be considered essentially uncharged at a pH of about 6.5.

e) For the purposes of comparing two or more nucleotide sequences, the percentage of "sequence identity" between a first nucleotide sequence and a second nucleotide sequence may be calculated by dividing [the number of nucleotides in the first nucleotide sequence that are identical to the nucleotides at the corresponding positions in the second nucleotide sequence] by [the total number of nucleotides in the first nucleotide sequence] and multiplying by [100%], in which each deletion, insertion, substitution or addition of a nucleotide in the second nucleotide sequence—compared to the first nucleotide sequence—is considered as a difference at a single nucleotide (position).
Alternatively, the degree of sequence identity between two or more nucleotide sequences may be calculated using a known computer algorithm for sequence alignment such as NCBI Blast v2.0, using standard settings.
Some other techniques, computer algorithms and settings for determining the degree of sequence identity are for example described in WO 04/037999, EP 0 967 284, EP 1 085 089, WO 00/55318, WO 00/78972, WO 98/49185 and GB 2 357 768-A.

Usually, for the purpose of determining the percentage of "sequence identity" between two nucleotide sequences in accordance with the calculation method outlined hereinabove, the nucleotide sequence with the greatest number of nucleotides will be taken as the "first" nucleotide sequence, and the other nucleotide sequence will be taken as the "second" nucleotide sequence;

f) For the purposes of comparing two or more amino acid sequences, the percentage of "sequence identity" between a first amino acid sequence and a second amino acid sequence (also referred to herein as "amino acid identity") may be calculated by dividing [the number of amino acid residues in the first amino acid sequence that are identical to the amino acid residues at the corresponding positions in the second amino acid sequence] by [the total number of amino acid residues in the first amino acid sequence] and multiplying by [100%], in which each deletion, insertion, substitution or addition of an amino acid residue in the second amino acid sequence—compared to the first amino acid sequence—is considered as a difference at a single amino acid residue (position), i.e. as an "amino acid difference" as defined herein.
Alternatively, the degree of sequence identity between two amino acid sequences may be calculated using a known computer algorithm, such as those mentioned above for determining the degree of sequence identity for nucleotide sequences, again using standard settings.
Usually, for the purpose of determining the percentage of "sequence identity" between two amino acid sequences in accordance with the calculation method outlined hereinabove, the amino acid sequence with the greatest number of amino acid residues will be taken as the "first" amino acid sequence, and the other amino acid sequence will be taken as the "second" amino acid sequence.
Also, in determining the degree of sequence identity between two amino acid sequences, the skilled person may take into account so-called "conservative" amino acid substitutions, which can generally be described as amino acid substitutions in which an amino acid residue is replaced with another amino acid residue of similar chemical structure and which has little or essentially no influence on the function, activity or other biological properties of the polypeptide. Such conservative amino acid substitutions are well known in the art, for example from WO 04/037999, GB-A-3 357 768, WO 98/49185, WO 00/46383 and WO 01/09300; and (preferred) types and/or combinations of such substitutions may be selected on the basis of the pertinent teachings from WO 04/037999 as well as WO 98/49185 and from the further references cited therein.
Such conservative substitutions preferably are substitutions in which one amino acid within the following groups (a)-(e) is substituted by another amino acid residue within the same group: (a) small aliphatic, nonpolar or slightly polar residues: Ala, Ser, Thr, Pro and Gly; (b) polar, negatively charged residues and their (uncharged) amides: Asp, Asn, Glu and Gln; (c) polar, positively charged residues: His, Arg and Lys; (d) large aliphatic, nonpolar residues: Met, Leu, Ile, Val and Cys; and (e) aromatic residues: Phe, Tyr and Trp.
Particularly preferred conservative substitutions are as follows: Ala into Gly or into Ser; Arg into Lys; Asn into Gln or into His; Asp into Glu; Cys into Ser; Gln into Asn; Glu into Asp; Gly into Ala or into Pro; His into Asn or into Gln; Ile into Leu or into Val; Leu into Ile or into Val; Lys into Arg, into Gln or into Glu; Met into Leu, into Tyr or into Ile; Phe into Met, into Leu or into Tyr; Ser into Thr; Thr into Ser; Trp into Tyr; Tyr into Trp; and/or Phe into Val, into Ile or into Leu.

Any amino acid substitutions applied to the polypeptides described herein may also be based on the analysis of the frequencies of amino acid variations between homologous proteins of different species developed by Schulz et al., Principles of Protein Structure, Springer-Verlag, 1978, on the analyses of structure forming potentials developed by Chou and Fasman, Biochemistry 13: 211, 1974 and Adv. Enzymol., 47: 45-149, 1978, and on the analysis of hydrophobicity patterns in proteins developed by Eisenberg et al., Proc. Nad. Acad Sci. USA 81: 140-144, 1984; Kyte & Doolittle; J Molec. Biol. 157: 105-132, 198 1, and Goldman et al., Ann. Rev. Biophys. Chem. 15: 321-353, 1986, all incorporated herein in their entirety by reference. Information on the primary, secondary and tertiary structure of Nanobodies is given in the description herein and in the general background art cited above. Also, for this purpose, the crystal structure of a $V_{HH}$ domain from a llama is for example given by Desmyter et al., Nature Structural Biology, Vol. 3, 9, 803 (1996); Spinelli et al., Natural Structural Biology (1996); 3, 752-757; and Decanniere et al., Structure, Vol. 7, 4, 361 (1999). Further information about some of the amino acid residues that in conventional $V_H$ domains form the $V_H/V_L$ interface and potential camelizing substitutions on these positions can be found in the prior art cited above.

g) Amino acid sequences and nucleic acid sequences are said to be "exactly the same" if they have 100% sequence identity (as defined herein) over their entire length;

h) When comparing two amino acid sequences, the term "amino acid difference" refers to an insertion, deletion or substitution of a single amino acid residue on a position of the first sequence, compared to the second sequence; it being understood that two amino acid sequences can contain one, two or more such amino acid differences;

i) When a nucleotide sequence or amino acid sequence is said to "comprise" another nucleotide sequence or amino acid sequence, respectively, or to "essentially consist of" another nucleotide sequence or amino acid sequence, this may mean that the latter nucleotide sequence or amino acid sequence has been incorporated into the firstmentioned nucleotide sequence or amino acid sequence, respectively, but more usually this generally means that the firstmentioned nucleotide sequence or amino acid sequence comprises within its sequence a stretch of nucleotides or amino acid residues, respectively, that has the same nucleotide sequence or amino acid sequence, respectively, as the latter sequence, irrespective of how the firstmentioned sequence has actually been generated or obtained (which may for example be by any suitable method described herein). By means of a non-limiting example, when a Nanobody of the invention is said to comprise a CDR sequence, this may mean that said CDR sequence has been incorporated into the Nanobody of the invention, but more usually this generally means that the Nanobody of the invention contains within its sequence a stretch of amino acid residues with the same amino acid sequence as said CDR sequence, irrespective of how said Nanobody of the invention has been generated or obtained. It should also be noted that when the latter amino acid sequence has a specific biological or structural function, it preferably has essentially the same, a similar or an equivalent biological or structural function in the firstmentioned amino acid sequence (in other words, the firstmentioned amino acid sequence is preferably such that the latter sequence is capable of performing essentially the same, a similar or an equivalent biological or structural function). For example, when a Nanobody of the invention is said to comprise a CDR sequence or framework sequence, respectively, the CDR sequence and framework are preferably capable, in said Nanobody, of functioning as a CDR sequence or framework sequence, respectively. Also, when a nucleotide sequence is said to comprise another nucleotide sequence, the firstmentioned nucleotide sequence is preferably such that, when it is expressed into an expression product (e.g. a polypeptide), the amino acid sequence encoded by the latter nucleotide sequence forms part of said expression product (in other words, that the latter nucleotide sequence is in the same reading frame as the firstmentioned, larger nucleotide sequence).

j) A nucleic acid sequence or amino acid sequence is considered to be "(in) essentially isolated (form)"—for example, compared to its native biological source and/or the reaction medium or cultivation medium from which it has been obtained—when it has been separated from at least one other component with which it is usually associated in said source or medium, such as another nucleic acid, another protein/polypeptide, another biological component or macromolecule or at least one contaminant, impurity or minor component. In particular, a nucleic acid sequence or amino acid sequence is considered "essentially isolated" when it has been purified at least 2-fold, in particular at least 10-fold, more in particular at least 100-fold, and up to 1000-fold or more. A nucleic acid sequence or amino acid sequence that is "in essentially isolated form" is preferably essentially homogeneous, as determined using a suitable technique, such as a suitable chromatographical technique, such as polyacrylamide-gel electrophoresis;

k) The term "domain" as used herein generally refers to a globular region of an amino acid sequence (such as an antibody chain, and in particular to a globular region of a heavy chain antibody), or to a polypeptide that essentially consists of such a globular region. Usually, such a domain will comprise peptide loops (for example 3 or 4 peptide loops) stabilized, for example, as a sheet or by disulfide bonds. The term "binding domain" refers to such a domain that is directed against an antigenic determinant (as defined herein);

l) The term "antigenic determinant" refers to the epitope on the antigen recognized by the antigen-binding molecule (such as a Nanobody or a polypeptide of the invention) and more in particular by the antigen-binding site of said molecule. The terms "antigenic determinant" and "epitope" may also be used interchangeably herein.

m) An amino acid sequence (such as a Nanobody, an antibody, a polypeptide of the invention, or generally an antigen binding protein or polypeptide or a fragment thereof) that can (specifically) bind to, that has affinity for and/or that has specificity for a specific antigenic determinant, epitope, antigen or protein (or for at least one part, fragment or epitope thereof) is said to be "against" or "directed against" said antigenic determinant, epitope, antigen or protein.

n) The term "specificity" refers to the number of different types of antigens or antigenic determinants to which a particular antigen-binding molecule or antigen-binding protein (such as a Nanobody or a polypeptide of the invention) molecule can bind. The specificity of an antigen-binding protein can be determined based on affinity and/or avidity. The affinity, represented by the equilibrium constant for the dissociation of an antigen with an antigen-binding protein ($K_D$), is a measure for the binding strength between an antigenic determinant and an antigen-binding site on the antigen-binding protein: the lesser the value of the $K_D$, the stronger the binding strength between an antigenic determinant and the antigen-binding molecule (alternatively, the affinity can also be expressed as the affinity constant ($K_A$), which is $1/K_D$). As will be clear to the skilled person (for example on the basis of the further disclosure herein), affinity can be determined in a manner known per se, depending on the specific antigen of interest. Avidity is the measure of the strength of binding between an antigen-binding molecule (such as a Nanobody or polypeptide of the invention) and the pertinent antigen. Avidity is related to both the affinity between an antigenic determinant and its antigen binding site on the antigen-binding molecule and the number of pertinent binding sites present on the antigen-binding molecule. Typically, antigen-binding proteins (such as the amino acid sequences, Nanobodies and/or polypeptides of the invention) will bind to their antigen with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles). Any $K_D$ value greater than $10^4$ mol/liter (or any $K_A$ value lower than $10^4 M^{-1}$) liters/mol is generally considered to indicate non-specific binding. Preferably, a monovalent immunoglobulin sequence of the invention will bind to the desired antigen with an affinity less than 500 nM, preferably less than 200 nM, more preferably less than 10 nM, such as less than 500 pM. Specific binding of an antigen-binding protein to an antigen or antigenic determinant can be determined in any suitable manner known per se, including, for example, Scatchard analysis and/or competitive binding assays, such as radioimmunoassays (RIA), enzyme immunoassays (EIA) and sandwich competition assays, and the different variants thereof known per se in the art; as well as the other techniques mentioned herein.

The dissociation constant may be the actual or apparent dissociation constant, as will be clear to the skilled person. Methods for determining the dissociation constant will be clear to the skilled person, and for example include the techniques mentioned herein. In this respect, it will also be clear that it may not be possible to measure dissociation constants of more then $10^{-4}$ moles/liter or $10^{-3}$ moles/liter (e,g, of $10^{-2}$ moles/liter). Optionally, as will also be clear to the skilled person, the (actual or apparent) dissociation constant may be calculated on the basis of the (actual or apparent) association constant ($K_A$), by means of the relationship [$K_D=1/K_A$].

The affinity denotes the strength or stability of a molecular interaction. The affinity is commonly given as by the $K_D$, or dissociation constant, which has units of mol/liter (or M). The affinity can also be expressed as an association constant, $K_A$, which equals $1/K_D$ and has units of (mol/liter)$^{-1}$ (or $M^{-1}$). In the present specification, the stability of the interaction between two molecules (such as an amino acid sequence, Nanobody or polypeptide of the invention and its intended target) will mainly be expressed in terms of the $K_D$ value of their interaction; it being clear to the skilled person that in view of the relation $K_A=1/K_D$, specifying the strength of molecular interaction by its $K_D$ value can also be used to calculate the corresponding $K_A$ value. The $K_D$-value characterizes the strength of a molecular interaction also in a thermodynamic sense as it is related to the free energy (DG) of binding by the well known relation $DG=RT \cdot \ln(K_D)$ (equivalently $DG=-RT \cdot \ln(K_A)$), where R equals the gas constant, T equals the absolute temperature and ln denotes the natural logarithm.

The $K_D$ for biological interactions which are considered meaningful (e.g. specific) are typically in the range of $10^{-10}$ M (0.1 nM) to $10^{-5}$ M (10000 nM). The stronger an interaction is, the lower is its $K_D$.

The $K_D$ can also be expressed as the ratio of the dissociation rate constant of a complex, denoted as $k_{off}$, to the rate of its association, denoted $k_{on}$ (so that $K_D=k_{off}/k_{on}$ and $K_A=k_{on}/k_{off}$). The off-rate $k_{off}$ has units s$^{-1}$ (where s is the SI unit notation of second). The on-rate $k_{on}$ has units $M^{-1} s^{-1}$. The on-rate may vary between $10^2 M^{-1} s^{-1}$ to about $10^7 M^{-1} s^{-1}$, approaching the diffusion-limited association rate constant for bimolecular interactions. The off-rate is related to the half-life of a given molecular interaction by the relation $t_{1/2}=\ln(2)/k_{off}$. The off-rate may vary between $10^{-6}$ s$^{-1}$ (near irreversible complex with a $t_{1/2}$ of multiple days) to 1 s$^{-1}$ ($t_{1/2}=0.69$ s).

The affinity of a molecular interaction between two molecules can be measured via different techniques known per se, such as the well known surface plasmon resonance (SPR) biosensor technique (see for example Ober et al., Intern. Immunology, 13, 1551-1559, 2001) where one molecule is immobilized on the biosensor chip and the other molecule is passed over the immobilized molecule under flow conditions yielding $k_{on}$, $k_{off}$ measurements and hence $K_D$ (or $K_A$) values. This can for example be performed using the well-known BIACORE instruments.

It will also be clear to the skilled person that the measured $K_D$ may correspond to the apparent $K_D$ if the measuring process somehow influences the intrinsic binding affinity of the implied molecules for example by artefacts related to the coating on the biosensor of one molecule. Also, an apparent $K_D$ may be measured if one molecule contains more than one recognition sites for the other molecule. In such situation the measured affinity may be affected by the avidity of the interaction by the two molecules.

Another approach that may be used to assess affinity is the 2-step ELISA (Enzyme-Linked Immunosorbent Assay) procedure of Friguet et al. (J. Immunol. Methods, 77, 305-19, 1985). This method establishes a solution phase binding equilibrium measurement and avoids possible artefacts relating to adsorption of one of the molecules on a support such as plastic.

However, the accurate measurement of $K_D$ may be quite labor-intensive and as consequence, often apparent $K_D$ values are determined to assess the binding strength of two molecules. It should be noted that as long all measurements are made in a consistent way (e.g. keeping the assay conditions unchanged) apparent $K_D$ measurements can be used as an approximation of the true $K_D$ and hence in the present document $K_D$ and apparent $K_D$ should be treated with equal importance or relevance.

Finally, it should be noted that in many situations the experienced scientist may judge it to be convenient to determine the binding affinity relative to some reference molecule. For example, to assess the binding strength between molecules A and B, one may e.g. use a reference molecule C that is known to bind to B and that is suitably labelled with a fluorophore or chromophore group or other chemical moiety, such as biotin for easy detection in an ELISA or FACS (Fluorescent activated cell sorting) or other format (the fluorophore for fluorescence detection, the chromophore for light absorption detection, the biotin for streptavidin-mediated ELISA detection). Typically, the reference molecule C is kept at a fixed concentration and the concentration of A is varied for a given concentration or amount of B. As a result an $IC_{50}$ value is obtained corresponding to the concentration of A at which the signal measured for C in absence of A is halved. Provided $K_{D\ ref}$, the $K_D$ of the reference molecule, is known, as well as the total concentration $c_{ref}$ of the reference molecule, the apparent $K_D$ for the interaction A-B can be obtained from following formula: $K_D = IC_{50}/(1+c_{ref}/K_{D\ ref})$. Note that if $c_{ref} \ll K_{D\ ref}$, $K_D \approx IC_{50}$. Provided the measurement of the $IC_{50}$ is performed in a consistent way (e.g. keeping $c_{ref}$ fixed) for the binders that are compared, the strength or stability of a molecular interaction can be assessed by the $IC_{50}$ and this measurement is judged as equivalent to $K_D$ or to apparent $K_D$ throughout this text.

o) The half-life of an amino acid sequence, compound or polypeptide of the invention can generally be defined as the time taken for the serum concentration of the amino acid sequence, compound or polypeptide to be reduced by 50%, in vivo, for example due to degradation of the sequence or compound and/or clearance or sequestration of the sequence or compound by natural mechanisms. The in vivo half-life of an amino acid sequence, compound or polypeptide of the invention can be determined in any manner known per se, such as by pharmacokinetic analysis. Suitable techniques will be clear to the person skilled in the art, and may for example generally involve the steps of suitably administering to a warm-blooded animal (i.e. to a human or to another suitable mammal, such as a mouse, rabbit, rat, pig, dog or a primate, for example monkeys from the genus *Macaca* (such as, and in particular, cynomologus monkeys (*Macaca fascicularis*) and/or rhesus monkeys (*Macaca mulatta*)) and baboon (*Papio ursinus*)) a suitable dose of the amino acid sequence, compound or polypeptide of the invention; collecting blood samples or other samples from said animal; determining the level or concentration of the amino acid sequence, compound or polypeptide of the invention in said blood sample; and calculating, from (a plot of) the data thus obtained, the time until the level or concentration of the amino acid sequence, compound or polypeptide of the invention has been reduced by 50% compared to the initial level upon dosing. Reference is for example made to the Experimental Part below, as well as to the standard handbooks, such as Kenneth, A et al: Chemical Stability of Pharmaceuticals: A Handbook for Pharmacists and Peters et al, Pharmacokinete analysis: A Practical Approach (1996). Reference is also made to "Pharmacokinetics", M Gibaldi & D Perron, published by Marcel Dekker, 2nd Rev. edition (1982).

As will also be clear to the skilled person (see for example pages 6 and 7 of WO 04/003019 and in the further references cited therein), the half-life can be expressed using parameters such as the t1/2-alpha, t1/2-beta and the area under the curve (AUC). In the present specification, an "increase in half-life" refers to an increase in any one of these parameters, such as any two of these parameters, or essentially all three these parameters. As used herein "increase in half-life" or "increased half-life" in particular refers to an increase in the t1/2-beta, either with or without an increase in the t1/2-alpha and/or the AUC or both.

p) In the context of the present invention, "modulating" or "to modulate" generally means either reducing or inhibiting the activity of, or alternatively increasing the activity of, a target or antigen, as measured using a suitable in vitro, cellular or in vivo assay. In particular, "modulating" or "to modulate" may mean either reducing or inhibiting the activity of, or alternatively increasing a (relevant or intended) biological activity of, a target or antigen, as measured using a suitable in vitro, cellular or in vivo assay (which will usually depend on the target or antigen involved), by at least 1%, preferably at least 5%, such as at least 10% or at least 25%, for example by at least 50%, at least 60%, at least 70%, at least 80%, or 90% or more, compared to activity of the target or antigen in the same assay under the same conditions but without the presence of the construct of the invention.

As will be clear to the skilled person, "modulating" may also involve effecting a change (which may either be an increase or a decrease) in affinity, avidity, specificity and/or selectivity of a target or antigen for one or more of its ligands, binding partners, partners for association into a homomultimeric or heteromultimeric form, or substrates; and/or effecting a change (which may either be an increase or a decrease) in the sensitivity of the target or antigen for one or more conditions in the medium or surroundings in which the target or antigen is present (such as pH, ion strength, the presence of cofactors, etc.), compared to the same conditions but without the presence of the construct of the invention. As will be clear to the skilled person, this may again be determined in any suitable manner and/or using any suitable assay known per se, depending on the target or antigen involved.

"Modulating" may also mean effecting a change (i.e. an activity as an agonist, as an antagonist or as a reverse agonist, respectively, depending on the target or antigen and the desired biological or physiological effect) with respect to one or more biological or physiological mechanisms, effects, responses, functions, pathways or activities in which the target or antigen (or in which its substrate(s), ligand(s) or pathway(s) are involved, such as its signalling pathway or metabolic pathway and their associated biological or physiological effects) is involved. Again, as will be clear to the skilled person, such an action as an agonist or an antagonist may be determined in any suitable manner and/or using any suitable (in vitro and usually cellular or in assay) assay known per se, depending on the target or antigen involved. In particular, an action as an agonist or antagonist may be such that an intended biological or physiological activity is increased or decreased, respectively, by at least 1%, preferably at least 5%, such as at least 10% or at least 25%, for example by at least 50%, at least 60%, at least 70%, at least 80%, or 90% or more, compared to the biological or physiological activity in the same assay under the same conditions but without the presence of the construct of the invention.

Modulating may for example also involve allosteric modulation of the target or antigen; and/or reducing or inhibiting the binding of the target or antigen to one of its substrates or ligands and/or competing with a natural ligand, substrate for binding to the target or antigen. Modulating may also involve activating the target or antigen or the mechanism or pathway in which it is involved. Modulating may for example also involve effecting a change in respect of the folding or confirmation of the target or antigen, or in respect of the ability of the target or antigen to fold, to change its confirmation (for example, upon binding of a ligand), to associate with other (sub)units, or to disassociate. Modulating may for example also involve effecting a change in the ability of the target or antigen to transport other compounds or to serve as a channel for other compounds (such as ions).

Modulating may be reversible or irreversible, but for pharmaceutical and pharmacological purposes will usually be in a reversible manner.

q) In respect of a target or antigen, the term "interaction site" on the target or antigen means a site, epitope, antigenic determinant, part, domain or stretch of amino acid residues on the target or antigen that is a site for binding to a ligand, receptor or other binding partner, a catalytic site, a cleavage site, a site for allosteric interaction, a site involved in multimerisation (such as homomerization or heterodimerization) of the target or antigen; or any other site, epitope, antigenic determinant, part, domain or stretch of amino acid residues on the target or antigen that is involved in a biological action or mechanism of the target or antigen. More generally, an "interaction site" can be any site, epitope, antigenic determinant, part, domain or stretch of amino acid residues on the target or antigen to which an amino acid sequence or polypeptide of the invention can bind such that the target or antigen (and/or any pathway, interaction, signalling, biological mechanism or biological effect in which the target or antigen is involved) is modulated (as defined herein).

r) An amino acid sequence or polypeptide is said to be "specific for" a first target or antigen compared to a second target or antigen when is binds to the first antigen with an affinity (as described above, and suitably expressed as a $K_D$ value, $K_A$ value, $K_{off}$ rate and/or $K_{on}$ rate) that is at least 10 times, such as at least 100 times, and preferably at least 1000 times, and up to 10.000 times or more better than the affinity with which said amino acid sequence or polypeptide binds to the second target or polypeptide. For example, the first antigen may bind to the target or antigen with a $K_D$ value that is at least 10 times less, such as at least 100 times less, and preferably at least 1000 times less, such as 10.000 times less or even less than that, than the $K_D$ with which said amino acid sequence or polypeptide binds to the second target or polypeptide. Preferably, when an amino acid sequence or polypeptide is "specific for" a first target or antigen compared to a second target or antigen, it is directed against (as defined herein) said first target or antigen, but not directed against said second target or antigen.

s) The terms "cross-block", "cross-blocked" and "cross-blocking" are used interchangeably herein to mean the ability of an amino acid sequence or other binding agents (such as a polypeptide of the invention) to interfere with the binding of other amino acid sequences or binding agents of the invention to a given target. The extend to which an amino acid sequence or other binding agent of the invention is able to interfere with the binding of another amino acid sequence or other binding agent to said target, and therefore, whether it can be said to cross-block according to the invention, can be determined using competition binding assays (also referred to herein as "cross-blocking assay"). One particularly suitable quantitative cross-blocking assay uses a Biacore instrument which can measure the extent of interactions using surface plasmon resonance technology. Another suitable quantitative cross-blocking assay uses an ELISA-based approach to measure competition between amino acid sequences or other binding agents in terms of their binding to the target.

The following generally describes a suitable Biacore assay for determining whether an amino acid sequence or other binding agent cross-blocks or is capable of cross-blocking according to the invention. It will be appreciated that the assay can be used with any of the amino acid sequences or other binding agents described herein. The Biacore instrument (for example the Biacore 3000) is operated in line with the manufacturer's recommendations. Thus, in one cross-blocking assay, the target protein is coupled to a CM5 Biacore chip using standard amine coupling chemistry to generate a surface that is coated with the target. Typically 200-800 resonance units of the target would be coupled to the chip (an amount that gives easily measurable levels of binding but that is readily saturable by the concentrations of test reagent being used). Two test amino acid sequences (termed A* and B*) or other binding agents to be assessed for their ability to cross-block each other are mixed at a one to one molar ratio of binding sites in a suitable buffer to create the test mixture. When calculating the concentrations on a binding site basis, the molecular weight of an amino acid sequence or other binding agent is assumed to be the total molecular weight of the amino acid sequence or other binding agent divided by the number of target binding sites on that amino acid sequence or other binding agent. The concentration of each amino acid sequence or other binding agent in the test mix should be high enough to readily saturate the binding sites for that amino acid sequence or other binding agent on the target molecules captured on the Biacore chip. The amino acid sequences or other binding agents in the mixture are at the same molar concentration (on a binding site basis) which would typically be between 1.00 and 1.5 micromolar (on a binding site basis). Separate solutions containing A* alone and B* alone are also prepared. A* and B* in these solutions should be in the same buffer and at the same concentration as in the test mix. The test mixture is passed over the target-coated Biacore chip and the total amount of binding recorded. The chip is then treated in such a way as to remove the bound amino acid sequences or other binding agents without damaging the chip-bound target. Typically this is done by treating the chip with 30 mM HCl for 60 seconds. The solution of A* alone is then passed over the target-coated surface and the amount of binding recorded. The chip is again treated to remove all of the bound amino acid sequences or other binding agents without damaging the chip-bound target. The solution of B* alone is then passed over the target-coated surface and the amount of binding recorded. The maximum theoretical binding of the mixture of A* and B* is next calculated, and is the sum of the binding of each amino acid sequence or other binding agent when passed over the target surface alone. If the actual recorded binding of the mixture is less than this theoretical maximum then the two amino acid sequences or other binding agents are cross-blocking each other. Thus, in general, a cross-blocking amino acid sequence or other binding agent according to the invention is one which will bind to the target in the above Biacore cross-blocking assay such that during the assay and in the presence of a second amino acid sequence or other binding agent of the invention the recorded binding is between 80% and 0.1% (e.g. 80% to 4%) of the maximum theoretical binding, specifically between 75% and 0.1% (e.g. 75% to 4%) of the maximum theoretical binding, and more specifically between 70% and 0.1% (e.g. 70% to 4%) of maximum theoretical binding (as just defined above) of the two amino acid sequences or binding agents in combination. The Biacore assay described above is a primary assay used to determine if amino acid sequences or other binding agents cross-block each other according to the invention. On rare occasions particular amino acid sequences or other binding agents may not bind to target coupled via amine chemistry to a CM5 Biacore chip (this usually occurs when the relevant binding site on target is masked or destroyed by the coupling to the chip). In such cases cross-blocking can be determined using a tagged version of the target, for example a N-terminal His-tagged version. In this particular format, an anti-His amino acid sequence would be coupled to the Biacore chip and then the His-tagged target would be passed over the surface of the chip and captured by the anti-His amino acid sequence. The cross blocking analysis would be carried out essentially as described above, except that after each chip regeneration cycle, new His-tagged target would be loaded back onto the anti-His amino acid sequence coated surface. In addition to the example given using N-terminal His-tagged target, C-terminal His-tagged target could alternatively be used. Furthermore, various other tags and tag binding protein combinations that are known in the art could be used for such a cross-blocking analysis (e.g. HA tag with anti-HA antibodies; FLAG tag with anti-FLAG antibodies; biotin tag with streptavidin).

The following generally describes an ELISA assay for determining whether an amino acid sequence or other binding agent directed against a target cross-blocks or is capable of cross-blocking as defined herein. It will be appreciated that the assay can be used with any of the amino acid sequences (or other binding agents such as polypeptides of the invention) described herein. The general principal of the assay is to have an amino acid sequence or binding agent that is directed against the target coated onto the wells of an ELISA plate. An excess amount of a second, potentially cross-blocking, anti-target amino acid sequence or other binding agent is added in solution (i.e. not bound to the ELISA plate). A limited amount of the target is then added to the wells. The coated amino acid sequence or other binding agent and the amino acid sequence or other binding agent in solution compete for binding of the limited number of target molecules. The plate is washed to remove excess target that has not been bound by the coated amino acid sequence or other binding agent and to also remove the second, solution phase amino acid sequence or other binding agent as well as any complexes formed between the second, solution phase amino acid sequence or other binding agent and target. The amount of bound target is then measured using a reagent that is appropriate to detect the target. An amino acid sequence or other binding agent in solution that is able to cross-block the coated amino acid sequence or other binding agent will be able to cause a decrease in the number of target molecules bound to the coated amino acid sequence or other binding agent relative to the number of target molecules bound to the coated amino acid sequence or other binding agent in the absence of the second, solution phase, amino acid sequence or other binding agent. In the instance where the first amino acid sequence or other binding agent, e.g. an Ab-X, is chosen to be the immobilized amino acid sequence or other binding agent, it is coated onto the wells of the ELISA plate, after which the plates are blocked with a suitable blocking solution to minimize non-specific binding of reagents that are subsequently added. An excess amount of the second amino acid sequence or other binding agent, i.e. Ab-Y, is then added to the ELISA plate such that the moles of Ab-Y target binding sites per well are at least 10 fold higher than the moles of Ab-X target binding sites that were used, per well, during the coating of the ELISA plate. Target is then added such that the moles of target added per well are at least 25-fold lower than the moles of Ab-X target binding sites that were used for coating each well. Following a suitable incubation period the ELISA plate is washed and a reagent for detecting the target is added to measure the amount of target specifically bound by the coated anti-target amino acid sequence or other binding agent (in this case Ab-X). The background signal for the assay is defined as the signal obtained in wells with the coated amino acid sequence or other binding agent (in this case Ab-X), second solution phase amino acid sequence or other binding agent (in this case Ab-Y), target buffer only (i.e. without target added) and target detection reagents. The positive control signal for the assay is defined as the signal obtained in wells with the coated amino acid sequence or other binding agent (in this case Ab-X), second solution phase amino acid sequence or other binding agent buffer only (i.e. without second solution phase amino acid sequence or other binding agent added), target and target detection reagents. The ELISA assay may be run in such a manner so as to have the positive control signal be at least 6 times the background signal. To avoid any artefacts (e.g. significantly different affinities between Ab-X and Ab-Y for the target) resulting from the choice of which amino acid sequence to use as the coating amino acid sequence or other binding agent and which to use as the second (competitor) amino acid sequence or other binding agent, the cross-blocking assay may to be run in two formats: 1) format 1 is where Ab-X is the amino acid sequence that is coated onto the ELISA plate and Ab-Y is the competitor amino acid sequence that is in solution and 2) format 2 is where Ab-Y is the amino acid sequence that is coated onto the ELISA plate and Ab-X is the competitor amino acid sequence that is in solution. Ab-X and Ab-Y are defined as cross-blocking if, either in format 1 or in format 2, the solution phase anti-target amino acid sequence or other binding agent is able to cause a reduction of between 60% and 100%, specifically between 70% and 100%, and more specifically between 80% and 100%, of the target detection signal {i.e. the amount of target bound by the coated amino acid sequence) as compared to the target detection signal obtained in the absence of the solution phase anti-target amino acid sequence or other binding agent (i.e. the positive control wells).

t) As further described herein, the total number of amino acid residues in a Nanobody can be in the region of 110-120, is preferably 112-115, and is most preferably 113. It should however be noted that parts, fragments, analogs or derivatives (as further described herein) of a Nanobody are not particularly limited as to their length and/or size, as long as such parts, fragments, analogs or derivatives meet the further requirements outlined herein and are also preferably suitable for the purposes described herein;

u) The amino acid residues of a Nanobody are numbered according to the general numbering for $V_H$ domains given by Kabat et al. ("Sequence of proteins of immunological interest", US Public Health Services, NIH Bethesda, Md., Publication No. 91), as applied to $V_{HH}$ domains from Camelids in the article of Riechmann and Muyldermans, J. Immunol. Methods 2000 Jun. 23; 240 (1-2): 185-195 (see for example FIG. 2 of this publication); or referred to herein. According to this numbering, FR1 of a Nanobody comprises the amino acid residues at positions 1-30, CDR1 of a Nanobody comprises the amino acid residues at positions 31-35, FR2 of a Nanobody comprises the amino acids at positions 36-49, CDR2 of a Nanobody comprises the amino acid residues at positions 50-65, FR3 of a Nanobody comprises the amino acid residues at positions 66-94, CDR3 of a Nanobody comprises the amino acid residues at positions 95-102, and FR4 of a Nanobody comprises the amino acid residues at positions 103-113. [In this respect, it should be noted that—as is well known in the art for $V_H$ domains and for $V_{HH}$ domains—the total number of amino acid residues in each of the CDR's may vary and may not correspond to the total number of amino acid residues indicated by the Kabat numbering (that is, one or more positions according to the Kabat numbering may not be occupied in the actual sequence, or the actual sequence may contain more amino acid residues than the number allowed for by the Kabat numbering). This means that, generally, the numbering according to Kabat may or may not correspond to the actual numbering of the amino acid residues in the actual sequence. Generally, however, it can be said that, according to the numbering of Kabat and irrespective of the number of amino acid residues in the CDR's, position 1 according to the Kabat numbering corresponds to the start of FR1 and vice versa, position 36 according to the Kabat numbering corresponds to the start of FR2 and vice versa, position 66 according to the Kabat numbering corresponds to the start of FR3 and vice versa, and position 103 according to the Kabat numbering corresponds to the start of FR4 and vice versa.].

Alternative methods for numbering the amino acid residues of $V_H$ domains, which methods can also be applied in an analogous manner to $V_{HH}$ domains from Camelids and to Nanobodies, are the method described by Chothia et al. (Nature 342, 877-883 (1989)), the so-called "AbM definition" and the so-called "contact definition". However, in the present description, claims and figures, the numbering according to Kabat as applied to $V_{HH}$ domains by Riechmann and Muyldermans will be followed, unless indicated otherwise; and v) The Figures, Sequence Listing and the Experimental Part/ Examples are only given to further illustrate the invention and should not be interpreted or construed as limiting the scope of the invention and/or of the appended claims in any way, unless explicitly indicated otherwise herein.

For a general description of heavy chain antibodies and the variable domains thereof, reference is inter alia made to the prior art cited herein, to the review article by Muyldermans in Reviews in Molecular Biotechnology 74 (2001), 277-302; as well as to the following patent applications, which are mentioned as general background art: WO 94/04678, WO 95/04079 and WO 96/34103 of the Vrije Universiteit Brussel; WO 94/25591, WO 99/37681, WO 00/40968, WO 00/43507, WO 00/65057, WO 01/40310, WO 01/44301, EP 1134231 and WO 02/48193 of Unilever; WO 97/49805, WO 01/21817, WO 03/035694, WO 03/054016 and WO 03/055527 of the Vlaams Instituut voor Biotechnologie (VIB); WO 03/050531 of Algonomics N.V. and Ablynx N.V.; WO 01/90190 by the National Research Council of Canada; WO 03/025020 (=EP 1 433 793) by the Institute of Antibodies; as well as WO 04/041867, WO 04/041862, WO 04/041865, WO 04/041863, WO 04/062551, WO 05/044858, WO 06/40153, WO 06/079372, WO 06/122786, WO 06/122787 and WO 06/122825, by Ablynx N.V. and the further published patent applications by Ablynx N.V. Reference is also made to the further prior art mentioned in these applications, and in particular to the list of references mentioned on pages 41-43 of the International application WO 06/040153, which list and references are incorporated herein by reference.

In accordance with the terminology used in the art (see the above references), the variable domains present in naturally occurring heavy chain antibodies will also be referred to as "$V_{HH}$ domains", in order to distinguish them from the heavy chain variable domains that are present in conventional 4-chain antibodies (which will be referred to hereinbelow as "$V_H$ domains") and from the light chain variable domains that are present in conventional 4-chain antibodies (which will be referred to hereinbelow as "$V_L$ domains").

As mentioned in the prior art referred to above, $V_{HH}$ domains have a number of unique structural characteristics and functional properties which make isolated $V_{HH}$ domains (as well as Nanobodies based thereon, which share these structural characteristics and functional properties with the naturally occurring $V_{HH}$ domains) and proteins containing the same highly advantageous for use as functional antigen-binding domains or proteins. In particular, and without being limited thereto, $V_{HH}$ domains (which have been "designed" by nature to functionally bind to an antigen without the presence of, and without any interaction with, a light chain variable domain) and Nanobodies can function as a single, relatively small, functional antigen-binding structural unit, domain or protein. This distinguishes the $V_{HH}$ domains from the $V_H$ and $V_L$ domains of conventional 4-chain antibodies, which by themselves are generally not suited for practical application as single antigen-binding proteins or domains, but need to be combined in some form or another to provide a functional antigen-binding unit (as in for example conventional antibody fragments such as Fab fragments; in ScFv's fragments, which consist of a $V_H$ domain covalently linked to a $V_L$ domain).

Because of these unique properties, the use of $V_{HH}$ domains and Nanobodies as single antigen-binding proteins or as antigen-binding domains (i.e. as part of a larger protein or polypeptide) offers a number of significant advantages over the use of conventional $V_H$ and $V_L$ domains, scFv's or conventional antibody fragments (such as Fab- or F(ab')$_2$-fragments):

only a single domain is required to bind an antigen with high affinity and with high selectivity, so that there is no need to have two separate domains present, nor to assure that these two domains are present in the right spacial conformation and configuration (i.e. through the use of especially designed linkers, as with scFv's);

$V_{HH}$ domains and Nanobodies can be expressed from a single gene and require no post-translational folding or modifications;

$V_{HH}$ domains and Nanobodies can easily be engineered into multivalent and multispecific formats (as further discussed herein);

$V_{HH}$ domains and Nanobodies are highly soluble and do not have a tendency to aggregate (as with the mouse-derived "dAb's" described by Ward et al., Nature, Vol. 341, 1989, p. 544);

$V_{HH}$ domains and Nanobodies are highly stable to heat, pH, proteases and other denaturing agents or conditions (see for example Ewert et al, supra);

$V_{HH}$ domains and Nanobodies are easy and relatively cheap to prepare, even on a scale required for production. For example, $V_{HH}$ domains, Nanobodies and proteins/polypeptides containing the same can be produced using microbial fermentation (e.g. as further described below) and do not require the use of mammalian expression systems, as with for example conventional antibody fragments;

$V_{HH}$ domains and Nanobodies are relatively small (approximately 15 kDa, or 10 times smaller than a conventional IgG) compared to conventional 4-chain antibodies and antigen-binding fragments thereof, and therefore show high(er) penetration into tissues (including but not limited to solid tumors and other dense tissues) than such conventional 4-chain antibodies and antigen-binding fragments thereof;

$V_{HH}$ domains and Nanobodies can show so-called cavity-binding properties (inter alia due to their extended CDR3 loop, compared to conventional $V_H$ domains) and can therefore also access targets and epitopes not accessible to conventional 4-chain antibodies and antigen-binding fragments thereof. For example, it has been shown that $V_{HH}$ domains and Nanobodies can inhibit enzymes (see for example WO 97/49805; Transue et al., Proteins 1998 Sep. 1; 32(4): 515-22; Lauwereys et al., EMBO J. 1998 Jul. 1; 17(13): 3512-20).

In a specific and preferred aspect, the invention provides Nanobodies that block the interaction between (a target on) an antigen presenting cell (APC) and (a target) on a T-cell. More particularly the invention provides Nanobodies against a target on an APC ("APC target") or a target on a T-cell ("T-cell target"), and in particular Nanobodies against an APC target or a T-cell target from a warm-blooded animal, and more in particular Nanobodies against APC target or a T-cell target from a mammal, and especially Nanobodies against human APC target or a T-cell target; as well as proteins and/or polypeptides comprising at least one such Nanobody. In particular, the invention provides Nanobodies against targets that belong to the B7:CD28 superfamily (which encompasses APC targets and T-cell targets). "APC targets" include (without being limiting) B7-1 (also referred to as CD80, BB1, B7, CD28 antigen ligand 1, CD28LG1, LAB1, B71 antigen), B7-2 (also referred to as CD86, CD28 antigen ligand 2, CD28LG2, LAB7-2 or B72 antigen), B7RP-1 (also referred to as B7h, iCOS-L, ICOS-L, ICOSL, LICOS, GL-50, B7H-2, B7-H2 or L-COS), PD-L1 (also referred to as PDL-1, B7H-1 or B7-H1), PD-L2 (also referred to as PDL-2 or B7-DC), B7H-3 (also referred to as B7RP-2) and B7x (also referred to as B7S). "T-cell targets" include (without being limiting) CD28, CTLA-4 (also referred to as CD152, CELIAC3, CTLA4, Ctla-4, sCTLA4 or IDDM12), ICOS, PD-1, BTLA and TIM-3. In a preferred aspect, the Nanobodies of the invention are directed against B7-1 and/or B7-2, i.e. they may be monospecific against only B7-1 or only B7-2, or they may be bispecific against both B7-1 and B7-2.

In particular, the invention provides Nanobodies against an APC target or a T-cell target, and proteins and/or polypeptides comprising the same, that have improved therapeutic and/or pharmacological properties and/or other advantageous properties (such as, for example, improved ease of preparation and/or reduced costs of goods), compared to conventional antibodies against the APC target or T-cell target or fragments thereof, compared to constructs that could be based on such conventional antibodies or antibody fragments (such as Fab' fragments, F(ab')$_2$ fragments, ScFv constructs, "diabodies" and other multispecific constructs (see for example the review by Holliger and Hudson, Nat Biotechnol. 2005 September; 23(9):1126-36)), and also compared to the so-called "dAb's" or similar (single) domain antibodies that may be derived from variable domains of conventional antibodies. These improved and advantageous properties will become clear from the further description herein, and for example include, without limitation, one or more of:

increased affinity and/or avidity for the APC target or T-cell target, either in a monovalent format, in a multivalent format (for example in a bivalent format) and/or in a multispecific format (for example one of the multispecific formats described hereinbelow);

better suitability for formatting in a multivalent format (for example in a bivalent format);

better suitability for formatting in a multispecific format (for example one of the multispecific formats described hereinbelow);

improved suitability or susceptibility for "humanizing" substitutions (as defined herein);

less immunogenicity, either in a monovalent format, in a multivalent format (for example in a bivalent format) and/or in a multispecific format (for example one of the multispecific formats described hereinbelow);

increased stability, either in a monovalent format, in a multivalent format (for example in a bivalent format) and/or in a multispecific format (for example one of the multispecific formats described hereinbelow);

increased specificity towards the APC target or T-cell target, either in a monovalent format, in a multivalent format (for example in a bivalent format) and/or in a multispecific format (for example one of the multispecific formats described hereinbelow);

decreased or where desired increased cross-reactivity with the APC target or T-cell target from different species; and/or one or more other improved properties desirable for pharmaceutical use (including prophylactic use and/or therapeutic use) and/or for diagnostic use (including but not limited to use for imaging purposes), either in a monovalent format, in a multivalent format (for example in a bivalent format) and/or in a multispecific format (for example one of the multispecific formats described hereinbelow).

As generally described herein for the amino acid sequences of the invention, the Nanobodies of the invention are preferably in essentially isolated form (as defined herein), or form part of a protein or polypeptide of the invention (as defined herein), which may comprise or essentially consist of one or more Nanobodies of the invention and which may optionally further comprise one or more further amino acid sequences (all optionally linked via one or more suitable linkers). For example, and without limitation, the one or more amino acid sequences of the invention may be used as a binding unit in such a protein or polypeptide, which may optionally contain one or more further amino acid sequences that can serve as a binding unit (i.e. against one or more other targets than the APC target or T-cell target), so as to provide a monovalent, multivalent or multispecific polypeptide of the invention, respectively, all as described herein. In particular, such a protein or polypeptide may comprise or essentially consist of one or more Nanobodies of the invention and optionally one or more (other) Nanobodies (i.e. directed against other targets than the APC target or T-cell target), all optionally linked via one or more suitable linkers, so as to provide a monovalent, multivalent or multispecific Nanobody construct, respectively, as further described herein. Such proteins or polypeptides may also be in essentially isolated form (as defined herein).

In a Nanobody of the invention, the binding site for binding against the APC target or T-cell target is preferably formed by the CDR sequences. Optionally, a Nanobody of the invention may also, and in addition to the at least one binding site for binding against the APC target or T-cell target, contain one or more further binding sites for binding against other antigens, proteins or targets. For methods and positions for introducing such second binding sites, reference is for example made to Keck and Huston, Biophysical Journal, 71, October 1996, 2002-2011; EP 0 640 130 and WO 06/07260.

As generally described herein for the amino acid sequences of the invention, when a Nanobody of the invention (or a polypeptide of the invention comprising the same) is intended for administration to a subject (for example for therapeutic and/or diagnostic purposes as described herein), it is preferably directed against a human APC target or T-cell target; whereas for veterinary purposes, it is preferably directed against an APC target or T-cell target from the species to be treated. Also, as with the amino acid sequences of the invention, a Nanobody of the invention may or may not be cross-reactive (i.e. directed against an APC target or T-cell target from two or more species of mammal, such as against a human APC target or T-cell target and an APC target or T-cell target from at least one of the species of mammal mentioned herein).

Also, again as generally described herein for the amino acid sequences of the invention, the Nanobodies of the invention may generally be directed against any antigenic determinant, epitope, part, domain, subunit or confirmation (where applicable) of the APC target or T-cell target. However, it is generally assumed and preferred that the Nanobodies of the invention (and polypeptides comprising the same) are directed against the site on the APC target or T-cell target by which said target interacts with its receptor or ligand respectively, i.e. for B7-1 and B7-2, the site on B7-1 and B7-2 respectively that interacts with CD28 or the site on B7-1 and B7-2 respectively that interacts with CTLA4 (Ellis et al. J. Immunol. 156(8): 2700-9, 1996; Stamper et al., Nature 410: 608-11, 2001, Erratum in: Nature 411: 617, 2001; Schwartz et al., Nature 410: 604-8, 2001; Ikemizu et al., Immunity. 12(1): 51-60, 2000; Zhang et al., Proc. Nat. Acad. Sci. 100: 2586, 2003), for B7RP-1, the site on B7RP-1 that interacts with ICOS, for PD-L1 and PD-L2, the site on PD-L1 and PD-L2 respectively that interacts with PD-1 and for B7H-3 and B7x, the site on B7H-3 and B7x respectively that interacts with BTLA, for CD28, the site on CD28 that interacts with B7-1 and/or B7-2, for CTLA4, the site on CTLA4 that interacts with B7-1 and/or B7-2, for ICOS, the site on ICOS that interacts with B7RP-1, for PD-1, the site on PD-1 that interacts with PD-L1 and/or PD-L2, for BTLA, the site on BTLA that interacts with B7H-3 and/or B7x. Thus, in one preferred, but non-limiting aspect, the Nanobodies of the invention are directed against the site on the APC target or on the T-cell target by which said target interacts with its receptor or ligand respectively, and are as further defined herein.

Else, the Nanobodies of the invention are preferably directed against a site on their target in the proximity of the site by which said target interacts with its receptor or ligand respectively, as to provide some sterical hindrance for the interaction of the target with its receptor or ligand. Preferably, the site against which the Nanobodies of the invention are directed is such that binding of the target to its receptor or ligand is modulated, and in particular inhibited or prevented.

In a specific aspect of the invention, the amino acid sequences and polypeptides of the invention are directed against a site on B7-1 such that the interaction of B7-1 with CD28 is modulated, and in particular inhibited or prevented. In another aspect of the invention, the amino acid sequences and polypeptides of the invention are directed against a site on B7-1, such that the interaction of B7-1 with CTLA4 is modulated, and in particular inhibited or prevented. In another aspect of the invention, the amino acid sequences and polypeptides of the invention are directed against a site on B7-1 such that the interaction of B7-1 with CD28 and the interaction of B7-1 with CTLA4 is modulated, and in particular inhibited or prevented. In another aspect of the invention, the amino acid sequences and polypeptides of the invention are directed against a site on B7-1, such that the interaction of B7-1 with CD28 is modulated, and in particular inhibited or prevented while the interaction of B7-1 with CTLA4 is not modulated, and in particular inhibited or prevented. In another aspect of the invention, the amino acid sequences and polypeptides of the invention are directed against a site on B7-1 such that the interaction of B7-1 with CTLA4 is modulated, and in particular inhibited or prevented while the interaction of B7-1 with CD28 is not modulated, and in particular inhibited or prevented.

In another specific aspect of the invention, the amino acid sequences and polypeptides of the invention are directed against a site on B7-2 such that the interaction of B7-2 with CD28 is modulated, and in particular inhibited or prevented. In another aspect of the invention, the amino acid sequences and polypeptides of the invention are directed against a site on B7-2, such that the interaction of B7-2 with CTLA4 is modulated, and in particular inhibited or prevented. In another aspect of the invention, the amino acid sequences and polypeptides of the invention are directed against a site on B7-2 such that the interaction of B7-2 with CD28 and the interaction of B7-2 with CTLA4 is modulated, and in particular inhibited or prevented. In another aspect of the invention, the amino acid sequences and polypeptides of the invention are directed against a site on B7-2, such that the interaction of B7-2 with CD28 is modulated, and in particular inhibited or prevented while the interaction of B7-2 with CTLA4 is not modulated, and in particular inhibited or prevented. In another aspect of the invention, the amino acid sequences and polypeptides of the invention are directed against a site on B7-2 such that the interaction of B7-2 with CTLA4 is modulated, and in particular inhibited or prevented while the interaction of B7-2 with CD28 is not modulated, and in particular inhibited or prevented.

In another specific aspect of the invention, the amino acid sequences and polypeptides of the invention are directed against a site on CD28 such that the interaction of CD28 with B7-1 is modulated, and in particular inhibited or prevented. In another aspect of the invention, the amino acid sequences and polypeptides of the invention are directed against a site on CD28, such that the interaction of CD28 with B7-2 is modulated, and in particular inhibited or prevented. In another aspect of the invention, the amino acid sequences and polypeptides of the invention are directed against a site on CD28 such that the interaction of CD28 with B7-1 and the interaction of CD28 with B7-2 is modulated, and in particular inhibited or prevented. In another aspect of the invention, the amino acid sequences and polypeptides of the invention are directed against a site on CD28, such that the interaction of CD28 with B7-1 is modulated, and in particular inhibited or prevented while the interaction of CD28 with B7-2 is not modulated, and in particular inhibited or prevented. In another aspect of the invention, the amino acid sequences and polypeptides of the invention are directed against a site on CD28 such that the interaction of CD28 with B7-2 is modulated, and in particular inhibited or prevented while the interaction of CD28 with B7-1 is not modulated, and in particular inhibited or prevented.

In another specific aspect of the invention, the amino acid sequences and polypeptides of the invention are directed against a site on CTLA4 such that the interaction of CTLA4 with B7-1 is modulated, and in particular inhibited or prevented. In another aspect of the invention, the amino acid sequences and polypeptides of the invention are directed against a site on CTLA4, such that the interaction of CTLA4 with B7-2 is modulated, and in particular inhibited or prevented. In another aspect of the invention, the amino acid sequences and polypeptides of the invention are directed against a site on CTLA4 such that the interaction of CTLA4 with B7-1 and the interaction of CTLA4 with B7-2 is modulated, and in particular inhibited or prevented. In another aspect of the invention, the amino acid sequences and polypeptides of the invention are directed against a site on CTLA4, such that the interaction of CTLA4 with B7-1 is modulated, and in particular inhibited or prevented while the interaction of CTLA4 with B7-2 is not modulated, and in particular inhibited or prevented. In another aspect of the invention, the amino acid sequences and polypeptides of the invention are directed against a site on CTLA4 such that the interaction of CTLA4 with B7-2 is modulated, and in particular inhibited or prevented while the interaction of CTLA4 with B7-1 is not modulated, and in particular inhibited or prevented.

In another specific aspect of the invention, the amino acid sequences and polypeptides of the invention are directed against a site on B7RP-1 or ICOS such that the interaction of B7RP-1 with ICOS is modulated, and in particular inhibited or prevented.

In another aspect of the invention, the amino acid sequences and polypeptides of the invention are directed against a site on PD-L1 or PD-L2 such that the interaction of PD-L1 or PD-L2 with PD-1 is modulated, and in particular inhibited or prevented.

In another aspect of the invention, the amino acid sequences and polypeptides of the invention are directed against a site on PD-1 such that the interaction of PD-1 with PD-L1 is modulated, and in particular inhibited or prevented. In another aspect of the invention, the amino acid sequences and polypeptides of the invention are directed against a site on PD-1 such that the interaction of PD-1 with PD-L2 is modulated, and in particular inhibited or prevented. In another aspect of the invention, the amino acid sequences and polypeptides of the invention are directed against a site on PD-1 such that the interaction of PD-1 with PD-L1 is modulated, and in particular inhibited or prevented and that the interaction of PD-1 with PD-L2 is modulated, and in particular inhibited or prevented. In another aspect of the invention, the amino acid sequences and polypeptides of the invention are directed against a site on PD-1 such that the interaction of PD-1 with PD-L1 is modulated, and in particular inhibited or prevented while the interaction of PD-1 with PD-L2 is not modulated, and in particular inhibited or prevented. In another aspect of the invention, the amino acid sequences and polypeptides of the invention are directed against a site on PD-1 such that the interaction of PD-1 with PD-L2 is modulated, and in particular inhibited or prevented while the interaction of PD-1 with PD-L1 is modulated, and in particular inhibited or prevented.

In another aspect of the invention, the amino acid sequences and polypeptides of the invention are directed against a site on B7H-3 or B7x such that the interaction of B7H-3 or B7x with BTLA is modulated, and in particular inhibited or prevented.

In another aspect of the invention, the amino acid sequences and polypeptides of the invention are directed against a site on BTLA such that the interaction of BTLA with B7H-3 is modulated, and in particular inhibited or prevented. In another aspect of the invention, the amino acid sequences and polypeptides of the invention are directed against a site on BTLA such that the interaction of BTLA with B7x is modulated, and in particular inhibited or prevented. In another aspect of the invention, the amino acid sequences and polypeptides of the invention are directed against a site on BTLA such that the interaction of BTLA with B7H-3 is modulated, and in particular inhibited or prevented and the interaction of BTLA with B7x is modulated, and in particular inhibited or prevented. In another aspect of the invention, the amino acid sequences and polypeptides of the invention are directed against a site on BTLA such that the interaction of BTLA with B7H-3 is modulated, and in particular inhibited or prevented while the interaction of BTLA with B7x is not modulated, and in particular inhibited or prevented. In another aspect of the invention, the amino acid sequences and polypeptides of the invention are directed against a site on BTLA such that the interaction of BTLA with B7x is modulated, and in particular inhibited or prevented while the interaction of BTLA with B7H-3 is not modulated, and in particular inhibited or prevented.

As already described herein, the amino acid sequence and structure of a Nanobody can be considered—without however being limited thereto—to be comprised of four framework regions or "FR's" (or sometimes also referred to as "FW's"), which are referred to in the art and herein as "Framework region 1" or "FR1"; as "Framework region 2" or "FR2"; as "Framework region 3" or "FR3"; and as "Framework region 4" or "FR4", respectively; which framework regions are interrupted by three complementary determining regions or "CDR's", which are referred to in the art as "Complementarity Determining Region 1" or "CDR1"; as "Complementarity Determining Region 2" or "CDR2"; and as "Complementarity Determining Region 3" or "CDR3", respectively. Some preferred framework sequences and CDR's (and combinations thereof) that are present in the Nanobodies of the invention are as described herein. Other suitable CDR sequences can be obtained by the methods described herein.

According to a non-limiting but preferred aspect of the invention, (the CDR sequences present in) the Nanobodies of the invention are such that:

the Nanobodies can bind to the APC target or T-cell target with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that:

the Nanobodies can bind to the APC target or T-cell target with a $k_{on}$-rate of between $10^2$ $M^{-1}$ $s^{-1}$ to about $10^7$ $M^{-1}$ $s^{-1}$, preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$;

and/or such that they:

the Nanobodies can bind to the APC target or T-cell target with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, (the CDR sequences present in) the Nanobodies of the invention are such that: a monovalent Nanobody of the invention (or a polypeptide that contains only one Nanobody of the invention) is preferably such that it will bind to the APC target or T-cell target with an affinity less than 500 nM, preferably less than 200 nM, more preferably less than 10 nM, such as less than 500 pM.

The affinity of the Nanobody of the invention against the APC target or T-cell target can be determined in a manner known per se, for example using the general techniques for measuring $K_D$, $K_A$, $k_{off}$ or $k_{on}$ mentioned herein, as well as some of the specific assays described herein.

Some preferred IC50 values for binding of the Nanobodies of the invention (and of polypeptides comprising the same) to the APC target or T-cell target will become clear from the further description and examples herein.

In a preferred but non-limiting aspect, the invention relates to a Nanobody (as defined herein) against B7-1 and/or B7-2, which consists of 4 framework regions (FR1 to FR4 respectively) and 3 complementarity determining regions (CDR1 to CDR3 respectively), in which:

CDR1 is chosen from the group consisting of:
a) the amino acid sequences of SEQ ID NO's: 146-165;
b) amino acid sequences that have at least 80% amino acid identity with at least one of the amino acid sequences of SEQ ID NO's: 146-165;
c) amino acid sequences that have 3, 2, or 1 amino acid difference with at least one of the amino acid sequences of SEQ ID NO's: 146-165;
and/or
CDR2 is chosen from the group consisting of:
d) the amino acid sequences of SEQ ID NO's: 186-205;
e) amino acid sequences that have at least 80% amino acid identity with at least one of the amino acid sequences of SEQ ID NO's: 186-205;
f) amino acid sequences that have 3, 2, or 1 amino acid difference with at least one of the amino acid sequences of SEQ ID NO's: 186-205;
and/or
CDR3 is chosen from the group consisting of:
g) the amino acid sequences of SEQ ID NO's: 226-245;
h) amino acid sequences that have at least 80% amino acid identity with at least one of the amino acid sequences of SEQ ID NO's: 226-245;
i) amino acid sequences that have 3, 2, or 1 amino acid difference with at least one of the amino acid sequences of SEQ ID NO's: 226-245;
or any suitable fragment of such an amino acid sequence.

In particular, according to this preferred but non-limiting aspect, the invention relates to a Nanobody (as defined herein) against B7-1 and/or B7-2, which consists of 4 framework regions (FR1 to FR4 respectively) and 3 complementarity determining regions (CDR1 to CDR3 respectively), in which:

CDR1 is chosen from the group consisting of:
a) the amino acid sequences of SEQ ID NO's: 146-165;
b) amino acid sequences that have at least 80% amino acid identity with at least one of the amino acid sequences of SEQ ID NO's: 146-165;
c) amino acid sequences that have 3, 2, or 1 amino acid difference with at least one of the amino acid sequences of SEQ ID NO's: 146-165;
and
CDR2 is chosen from the group consisting of:
d) the amino acid sequences of SEQ ID NO's: 186-205;
e) amino acid sequences that have at least 80% amino acid identity with at least one of the amino acid sequences of SEQ ID NO's: 186-205;
f) amino acid sequences that have 3, 2, or 1 amino acid difference with at least one of the amino acid sequences of SEQ ID NO's: 186-205;
and
CDR3 is chosen from the group consisting of:
g) the amino acid sequences of SEQ ID NO's: 226-245;
h) amino acid sequences that have at least 80% amino acid identity with at least one of the amino acid sequences of SEQ ID NO's: 226-245;
i) amino acid sequences that have 3, 2, or 1 amino acid difference with at least one of the amino acid sequences of SEQ ID NO's: 226-245;
or any suitable fragment of such an amino acid sequences.

As generally mentioned herein for the amino acid sequences of the invention, when a Nanobody of the invention contains one or more CDR1 sequences according to b) and/or c):
i) any amino acid substitution in such a CDR according to b) and/or c) is preferably, and compared to the corresponding CDR according to a), a conservative amino acid substitution (as defined herein);
and/or
ii) the CDR according to b) and/or c) preferably only contains amino acid substitutions, and no amino acid deletions or insertions, compared to the corresponding CDR according to a);
and/or
iii) the CDR according to b) and/or c) may be a CDR that is derived from a CDR according to a) by means of affinity maturation using one or more techniques of affinity maturation known per se.

Similarly, when a Nanobody of the invention contains one or more CDR2 sequences according to e) and/or f):
i) any amino acid substitution in such a CDR according to e) and/or f) is preferably, and compared to the corresponding CDR according to d), a conservative amino acid substitution (as defined herein);
and/or
ii) the CDR according to e) and/or f) preferably only contains amino acid substitutions, and no amino acid deletions or insertions, compared to the corresponding CDR according to d);
and/or
iii) the CDR according to e) and/or f) may be a CDR that is derived from a CDR according to d) by means of affinity maturation using one or more techniques of affinity maturation known per se.

Also, similarly, when a Nanobody of the invention contains one or more CDR3 sequences according to h) and/or i):
i) any amino acid substitution in such a CDR according to h) and/or i) is preferably, and compared to the corresponding CDR according to g), a conservative amino acid substitution (as defined herein);
and/or
ii) the CDR according to h) and/or i) preferably only contains amino acid substitutions, and no amino acid deletions or insertions, compared to the corresponding CDR according to g);
and/or
iii) the CDR according to h) and/or i) may be a CDR that is derived from a CDR according to g) by means of affinity maturation using one or more techniques of affinity maturation known per se.

It should be understood that the last three paragraphs generally apply to any Nanobody of the invention that comprises one or more CDR1 sequences, CDR2 sequences and/or CDR3 sequences according to b), c), e), f), h) or i), respectively.

Of the Nanobodies of the invention, Nanobodies comprising one or more of the CDR's explicitly listed above are particularly preferred; Nanobodies comprising two or more of the CDR's explicitly listed above are more particularly preferred; and Nanobodies comprising three of the CDR's explicitly listed above are most particularly preferred.

Some particularly preferred, but non-limiting combinations of CDR sequences, as well as preferred combinations of CDR sequences and framework sequences, are mentioned in Table A-1a below, which lists the CDR sequences and framework sequences that are present in a number of preferred (but non-limiting) Nanobodies of the invention. As will be clear to the skilled person, a combination of CDR1, CDR2 and CDR3 sequences that occur in the same clone (i.e. CDR1, CDR2 and CDR3 sequences that are mentioned on the same line in Table A-1a) will usually be preferred (although the invention in its broadest sense is not limited thereto, and also comprises other suitable combinations of the CDR sequences mentioned in Table A-1a). Also, a combination of CDR sequences and framework sequences that occur in the same clone (i.e. CDR sequences and framework sequences that are mentioned on the same line in Table A-1a) will usually be preferred (although the invention in its broadest sense is not limited thereto, and also comprises other suitable combinations of the CDR sequences and framework sequences mentioned in Table A-1a, as well as combinations of such CDR sequences and other suitable framework sequences, e.g. as further described herein).

Also, in the Nanobodies of the invention that comprise the combinations of CDR's mentioned in Table A-1a, each CDR can be replaced by a CDR chosen from the group consisting of amino acid sequences that have at least 80%, preferably at least 90%, more preferably at least 95%, even more preferably at least 99% sequence identity (as defined herein) with the mentioned CDR's; in which:

i) any amino acid substitution in such a CDR is preferably, and compared to the corresponding CDR sequence mentioned in Table A-1a, a conservative amino acid substitution (as defined herein);

and/or ii) any such CDR sequence preferably only contains amino acid substitutions, and no amino acid deletions or insertions, compared to the corresponding CDR sequence mentioned in Table A-1a;

and/or iii) any such CDR sequence is a CDR that is derived by means of a technique for affinity maturation known per se, and in particular starting from the corresponding CDR sequence mentioned in Table A-1a.

However, as will be clear to the skilled person, the (combinations of) CDR sequences, as well as (the combinations of) CDR sequences and framework sequences mentioned in Table A-1a will generally be preferred.

TABLE A-1a

Preferred combinations of CDR sequences, preferred combinations of framework sequences, and preferred combinations of framework and CDR sequences for Nanobodies against B7-1 and/or B7-2.
("ID" refers to the SEQ ID NO in the attached sequence listing)

| Clone | ID | FR1 | ID | CDR 1 | ID | FR2 | ID | CDR 2 | ID | FR3 | ID | CDR 3 | ID | FR4 |
|---|---|---|---|---|---|---|---|---|---|---|---|---|---|---|
| CD8086P MP1A1 | 126 | EVQLVESGGGL VQAGGSLRLSC AASGFTDG | 146 | IDAMG | 166 | WFRQAPG KEREFVA | 186 | SIGRSGNSA TNVDSVKG | 206 | RFTISRDNAKNTMYLQ MNSLKPEDTAGYYCAA | 226 | ATRRAYLP IRIRDYIY | 246 | WGQGT QVTVSS |
| CD8086P MP1A3 | 127 | EVQLVESGGGL VQAGGSLRLSC AASGPTSS | 147 | SYSMG | 167 | WFRQAPG KEREFVA | 187 | AINWSHGVT YYADSVKG | 207 | RFTISRDIAKNTVYLQM NSLKPEDTAVYYCAA | 227 | NEYGLGS SIYAYKH | 247 | WGQGT QVTVSS |
| CD8086P MP1B2 | 128 | EVQLVESGGGL VQAGGSLRLSC AASGRSFS | 148 | SYVMG | 168 | WFRQAPG KEREFVA | 188 | AIIGRDIGTYY ADSVKG | 208 | RFTISRDNAKTTVYLQ MNALKPEDTAVYYCAA | 228 | DSRSRLS GIRSAYDY | 248 | WGQGT VTVSS |
| CD8086P MP1C5 | 129 | EVQLVESGGG SVQAGGSLRLS CAATGRTFS | 149 | SYGMG | 169 | WFRQAPG KEREFVA | 189 | AIHWNSGITY YADSVKG | 209 | RFTISRDNAKNTVYLQ MSSLKPEDTAVYICAA | 229 | SSKGLTGT IRAYDD | 249 | WGQGT QVTVSS |
| CD8086P MP1C7 | 130 | EVQLVESGGGL VQAGGSLRLSC AASGRTFS | 150 | DYAAG | 170 | WFRQAPG KERDFVA | 190 | AINWSGGST YYADSVKG | 210 | RFTISRDNAKNTVYLQ MNSLKPEDTAVYYCAS | 230 | GWGRTTV LADTVXY | 250 | WGQGT QVTVSS |
| CD8086P MP1C9 | 131 | EVQLVESGGGL VQAGGSLRLSC AASGFXXG | 151 | IDAMG | 171 | WFRQAPG KEREFVA | 191 | SIXRSGGXAT XADSVKG | 211 | RFTISRDNAKNTMYLQ MNXLKPEDTAGYYCAA | 231 | ATRRPYLP IRISRLYL | 251 | XGPGXH XVTVSS |
| CD8086P MP1D1 | 132 | EVQLVESGGGL VQAGGSLRLSC AASGRTFS | 152 | SKAMG | 172 | WFRQAPG KERDFVA | 192 | AITWSGGST YYADHVKG | 212 | RFTISRDNAKNTVYLQ MNSLKPEDTAVYYCAT | 232 | NPYGLGQ VGYDY | 252 | WGQGT QVTVSS |
| CD8086P MP1D4 | 133 | EVQLVESGGGL VQAGGSLRLSC AASGFTDG | 153 | IDAMG | 173 | WFRQAPG KEREFVA | 193 | SIGRSGGSA TNADSVKG | 213 | RFTISRDNAKNTMYLQ MNSLKPEDTAGYYCAA | 233 | ATRRPYLP IRIRDYIY | 253 | WGQGT QVTVSS |
| CD8086P MP1E11 | 134 | EVQLVESGGGL VQPGGSLRLSC AASGFTLD | 154 | YSAIG | 174 | WFRQAPG KEREGVS | 194 | YISSSDGSTY YADSVEG | 214 | RFTISRDNAKNTLYLQ MNSLKPEDTAVYYCAA | 234 | GGPFTVST MPWLANY | 254 | WGQGT QVTVSS |

TABLE A-1a-continued

Preferred combinations of CDR sequences, preferred combinations of framework sequences, and preferred combinations of framework and CDR sequences for Nanobodies against B7-1 and/or B7-2.
("ID" refers to the SEQ ID NO in the attached sequence listing)

| Clone | ID | FR1 | ID | CDR 1 | ID | FR2 | ID | CDR 2 | ID | FR3 | ID | CDR 3 | ID | FR4 |
|---|---|---|---|---|---|---|---|---|---|---|---|---|---|---|
| CD8086P MP1F12 | 135 | EVQLVESGGGL VQAGGSLRLAC AASGLSFS | 155 | FYTMG | 175 | WFRQAPG EERDFVA | 195 | AINWSGGST LYAESVKG | 215 | RFTISRDNAKNTVYLQ MNSLKPEDTAVYYCAA | 235 | VRSVGRT YWTRALE YNY | 255 | WGQGT QVTVSS |
| CD8086P MP2A7 | 136 | EVQLVESGGGL VQAGGSLRLSC AASGRTFS | 156 | SKAMG | 176 | WFRQAPG KERDFVA | 196 | AITWSGGST YYADHVKG | 216 | RFTISRDNAKNTVYLQ MNSLKPEDTAVYYCAT | 236 | NPYGLGQ VGYDY | 256 | WGQGT QVTVSS |
| CD8086P MP2B10 | 137 | EVQLVESGGGL VQAGGSLRLSC TGSQISFS | 157 | DNTMN | 177 | WYRQVPG KQRELVA | 197 | SLSIFGATGY ADSVKG | 217 | RFTISRDIAGNTVYLQM NDLKIEDTAVYYCKL | 237 | GPVRRSR LEY | 257 | WGQGT QVTVSS |
| CD8086P MP2B4 | 138 | EVQLVESGGGL VQAGGSLRLSC AASGSIFS | 158 | IYTMG | 178 | WYRQAPG EQRELVA | 198 | AITSGGSTNY ADSVKG | 218 | RFTISRDNAKNTVYLQ MNSLKPEDTAVYYCNA | 238 | IAHEEGVY RWDF | 258 | WGQGT QVTVSS |
| CD8086P MP2C9 | 139 | EVQLVESGGGL VQAGGSLRLSC AASGSIFS | 159 | IYAMG | 179 | WYRQAPG KQRELVA | 199 | AITSGGSTNY ADSVMG | 219 | RFTISRDNAKNTVYLQ MNSLKPEDTAVYYCNA | 239 | NAHEEGV YRWDF | 259 | WGQGT QVTVSS |
| CD8086P MP2E6 | 140 | EVQLVESGGGL VQAGGSLRLSC AASGSIFS | 160 | IYDMG | 180 | WYRQAPG KQRVLVA | 200 | TITSGGSTNY ADSVKG | 220 | RFTISRDDAKNTVYLQ MNSLKPEDTAVYYCNA | 240 | IAHEEGVY RWDF | 260 | WGQGT QVTVSS |
| CD8086P MP2F5 | 141 | EVQLVKSGGGL VQAGGSLRLSC AASGSIFS | 161 | IYDMG | 181 | WYRQAPG KQRELVA | 201 | AITSGGSTNY ADSVKG | 221 | RFTISRDNAKNTVYLQ MNSLKPEDTAVYYCNA | 241 | IAYEEGVY RWDF | 261 | WGQGT QVTVSS |
| CD8086P MP2G4 | 142 | EVQLVESGGGL VQAGGSLRLSC AASGSIFS | 162 | IYDMG | 182 | WYRQAPG KQRVLVA | 202 | TITSGGSTNY ADSVKG | 222 | RFTISRDNAKNTVYLQ MNSLKPEDTAVYYCNA | 242 | IAHEEGVY RWDF | 262 | WGQGT QVTVSS |
| CD8086P MP2G8 | 143 | EVQLVKSGGGL VQPGGSLRLSC AASGFIFS | 163 | IYAMG | 183 | WYRQAPG KQRELVA | 203 | AITSGGSTNY ADSVKG | 223 | RFAISRDNAKNTVYLQ MNSLKPEDTAVYYCNA | 243 | NAHEEGV YRWDF | 263 | WGQGT QVTVSS |
| CD8086P MP2H11 | 144 | EVQLVESGGGL VQAGGSLRLSC AASGSIFS | 164 | IYTMG | 184 | WYRQAPG KQRELVA | 204 | AITSGGSTNY ADSVKG | 224 | RFTISRDNAKNTVYLQ MNSLKPEDTAVYYCNA | 244 | IAHEEGVY RWDF | 264 | WGQGT QVTVSS |
| CD8086P MP2H9 | 145 | EVQLVESGGGL VQAGGSLRLSC TASGSIFS | 165 | IDAMG | 185 | WYRQAPG KQRELVA | 205 | HISSGGSTN YADSVKG | 225 | RFTISRDNAKNTVYLQ MNSLKPEDTAVYYCTV | 245 | PRETGWD GDY | 265 | WGQGT QVTVSS |

Thus, in the Nanobodies of the invention, at least one of the CDR1, CDR2 and CDR3 sequences present is suitably chosen from the group consisting of the CDR1, CDR2 and CDR3 sequences, respectively, listed in Table A-1a; or from the group of CDR1, CDR2 and CDR3 sequences, respectively, that have at least 80%, preferably at least 90%, more preferably at least 95%, even more preferably at least 99% "sequence identity" (as defined herein) with at least one of the CDR1, CDR2 and CDR3 sequences, respectively, listed in Table A-1a; and/or from the group consisting of the CDR1, CDR2 and CDR3 sequences, respectively, that have 3, 2 or only 1 "amino acid difference(s)" (as defined herein) with at least one of the CDR1, CDR2 and CDR3 sequences, respectively, listed in Table A-1a.

In this context, by "suitably chosen" is meant that, as applicable, a CDR1 sequence is chosen from suitable CDR1 sequences (i.e. as defined herein), a CDR2 sequence is chosen from suitable CDR2 sequences (i.e. as defined herein), and a CDR3 sequence is chosen from suitable CDR3 sequence (i.e. as defined herein), respectively. More in particular, the CDR sequences are preferably chosen such that the Nanobodies of the invention bind to B7-1 and/or B7-2 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In particular, in the Nanobodies of the invention, at least the CDR3 sequence present is suitably chosen from the group consisting of the CDR3 sequences listed in Table A-1a or from the group of CDR3 sequences that have at least 80%, preferably at least 90%, more preferably at least 95%, even more preferably at least 99% sequence identity with at least one of the CDR3 sequences listed in Table A-1a; and/or from the group consisting of the CDR3 sequences that have 3, 2 or only 1 amino acid difference(s) with at least one of the CDR3 sequences listed in Table A-1a.

Preferably, in the Nanobodies of the invention, at least two of the CDR1, CDR2 and CDR3 sequences present are suitably chosen from the group consisting of the CDR1, CDR2 and CDR3 sequences, respectively, listed in Table A-1a or from the group consisting of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table A-1a; and/or from the group consisting of the CDR1, CDR2 and CDR3 sequences, respectively, that have 3, 2 or only 1 "amino acid difference(s)" with at least one of the CDR1, CDR2 and CDR3 sequences, respectively, listed in Table A-1a.

In particular, in the Nanobodies of the invention, at least the CDR3 sequence present is suitably chosen from the group consisting of the CDR3 sequences listed in Table A-1a or from the group of CDR3 sequences that have at least 80%, preferably at least 90%, more preferably at least 95%, even more preferably at least 99% sequence identity with at least one of the CDR3 sequences listed in Table A-1a, respectively; and at least one of the CDR1 and CDR2 sequences present is suitably chosen from the group consisting of the CDR1 and CDR2 sequences, respectively, listed in Table A-1a or from the group of CDR1 and CDR2 sequences, respectively, that have at least 80%, preferably at least 90%, more preferably at least 95%, even more preferably at least 99% sequence identity with at least one of the CDR1 and CDR2 sequences, respectively, listed in Table A-1a; and/or from the group consisting of the CDR1 and CDR2 sequences, respectively, that have 3, 2 or only 1 amino acid difference(s) with at least one of the CDR1 and CDR2 sequences, respectively, listed in Table A-1a.

Most preferably, in the Nanobodies of the invention, all three CDR1, CDR2 and CDR3 sequences present are suitably chosen from the group consisting of the CDR1, CDR2 and CDR3 sequences, respectively, listed in Table A-1a or from the group of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table A-1a; and/or from the group consisting of the CDR1, CDR2 and CDR3 sequences, respectively, that have 3, 2 or only 1 amino acid difference(s) with at least one of the CDR1, CDR2 and CDR3 sequences, respectively, listed in Table A-1a.

Even more preferably, in the Nanobodies of the invention, at least one of the CDR1, CDR2 and CDR3 sequences present is suitably chosen from the group consisting of the CDR1, CDR2 and CDR3 sequences, respectively, listed in Table A-1a. Preferably, in this aspect, at least one or preferably both of the other two CDR sequences present are suitably chosen from CDR sequences that have at least 80%, preferably at least 90%, more preferably at least 95%, even more preferably at least 99% sequence identity with at least one of the corresponding CDR sequences, respectively, listed in Table A-1a; and/or from the group consisting of the CDR sequences that have 3, 2 or only 1 amino acid difference(s) with at least one of the corresponding sequences, respectively, listed in Table A-1a.

In particular, in the Nanobodies of the invention, at least the CDR3 sequence present is suitably chosen from the group consisting of the CDR3 listed in Table A-1a. Preferably, in this aspect, at least one and preferably both of the CDR1 and CDR2 sequences present are suitably chosen from the groups of CDR1 and CDR2 sequences, respectively, that have at least 80%, preferably at least 90%, more preferably at least 95%, even more preferably at least 99% sequence identity with the CDR1 and CDR2 sequences, respectively, listed in Table A-1a; and/or from the group consisting of the CDR1 and CDR2 sequences, respectively, that have 3, 2 or only 1 amino acid difference(s) with at least one of the CDR1 and CDR2 sequences, respectively, listed in Table A-1a.

Even more preferably, in the Nanobodies of the invention, at least two of the CDR1, CDR2 and CDR3 sequences present are suitably chosen from the group consisting of the CDR1, CDR2 and CDR3 sequences, respectively, listed in Table A-1a. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table A-1a; and/or from the group consisting of CDR sequences that have 3, 2 or only 1 amino acid difference(s) with at least one of the corresponding sequences listed in Table A-1a.

In particular, in the Nanobodies of the invention, at least the CDR3 sequence is suitably chosen from the group consisting of the CDR3 sequences listed in Table A-1a, and either the CDR1 sequence or the CDR2 sequence is suitably chosen from the group consisting of the CDR1 and CDR2 sequences, respectively, listed in Table A-1a. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table A-1a; and/or from the group consisting of CDR sequences that have 3, 2 or only 1 amino acid difference(s) with the corresponding CDR sequences listed in Table A-1a.

Even more preferably, in the Nanobodies of the invention, all three CDR1, CDR2 and CDR3 sequences present are suitably chosen from the group consisting of the CDR1, CDR2 and CDR3 sequences, respectively, listed in Table A-1a.

Also, generally, the combinations of CDR's listed in Table A-1a (i.e. those mentioned on the same line in Table A-1a) are preferred. Thus, it is generally preferred that, when a CDR in a Nanobody of the invention is a CDR sequence mentioned in Table A-1a or is suitably chosen from the group of CDR sequences that have at least 80%, preferably at least 90%, more preferably at least 95%, even more preferably at least 99% sequence identity with a CDR sequence listed in Table A-1a; and/or from the group consisting of CDR sequences that have 3, 2 or only 1 amino acid difference(s) with a CDR sequence listed in Table A-1a, that at least one and preferably both of the other CDR's are suitably chosen from the CDR sequences that belong to the same combination in Table A-1a (i.e. mentioned on the same line in Table A-1a) or are suitably chosen from the group of CDR sequences that have at least 80%, preferably at least 90%, more preferably at least 95%, even more preferably at least 99% sequence identity with the CDR sequence(s) belonging to the same combination and/or from the group consisting of CDR sequences that have 3, 2 or only 1 amino acid difference(s) with the CDR sequence(s) belonging to the same combination. The other preferences indicated in the above paragraphs also apply to the combinations of CDR's mentioned in Table A-1a.

Thus, by means of non-limiting examples, a Nanobody of the invention can for example comprise a CDR1 sequence that has more than 80% sequence identity with one of the CDR1 sequences mentioned in Table A-1a, a CDR2 sequence that has 3, 2 or 1 amino acid difference with one of the CDR2 sequences mentioned in Table A-1a (but belonging to a different combination), and a CDR3 sequence.

Some preferred Nanobodies of the invention may for example comprise: (1) a CDR1 sequence that has more than 80% sequence identity with one of the CDR1 sequences mentioned in Table A-1a; a CDR2 sequence that has 3, 2 or 1 amino acid difference with one of the CDR2 sequences mentioned in Table A-1a (but belonging to a different combination); and a CDR3 sequence that has more than 80% sequence identity with one of the CDR3 sequences mentioned in Table A-1a (but belonging to a different combination); or (2) a CDR1 sequence that has more than 80% sequence identity with one of the CDR1 sequences mentioned in Table A-1a; a CDR2 sequence, and one of the CDR3 sequences listed in Table A-1a; or (3) a CDR1 sequence; a CDR2 sequence that has more than 80% sequence identity with one of the CDR2 sequence listed in Table A-1a; and a CDR3 sequence that has 3, 2 or 1 amino acid differences with the CDR3 sequence mentioned in Table A-1a that belongs to the same combination as the CDR2 sequence.

Some particularly preferred Nanobodies of the invention may for example comprise: (1) a CDR1 sequence that has more than 80% sequence identity with one of the CDR1 sequences mentioned in Table A-1a; a CDR2 sequence that has 3, 2 or 1 amino acid difference with the CDR2 sequence mentioned in Table A-1a that belongs to the same combination; and a CDR3 sequence that has more than 80% sequence identity with the CDR3 sequence mentioned in Table A-1a that belongs to the same combination; (2) a CDR1 sequence; a CDR 2 listed in Table A-1a and a CDR3 sequence listed in Table A-1a (in which the CDR2 sequence and CDR3 sequence may belong to different combinations).

Some even more preferred Nanobodies of the invention may for example comprise: (1) a CDR1 sequence that has more than 80% sequence identity with one of the CDR1 sequences mentioned in Table A-1a; the CDR2 sequence listed in Table A-1a that belongs to the same combination; and a CDR3 sequence mentioned in Table A-1a that belongs to a different combination; or (2) a CDR1 sequence mentioned in Table A-1a; a CDR2 sequence that has 3, 2 or 1 amino acid differences with the CDR2 sequence mentioned in Table A-1a that belongs to the same combination; and a CDR3 sequence that has more than 80% sequence identity with the CDR3 sequence listed in Table A-1a that belongs to the same or a different combination.

Particularly preferred Nanobodies of the invention may for example comprise a CDR1 sequence mentioned in Table A-1a, a CDR2 sequence that has more than 80% sequence identity with the CDR2 sequence mentioned in Table A-1a that belongs to the same combination; and the CDR3 sequence mentioned in Table A-1a that belongs to the same combination.

In the most preferred Nanobodies of the invention, the CDR1, CDR2 and CDR3 sequences present are suitably chosen from one of the combinations of CDR1, CDR2 and CDR3 sequences, respectively, listed in Table A-1a.

According to another preferred, but non-limiting aspect of the invention (a) CDR1 has a length of between 1 and 12 amino acid residues, and usually between 2 and 9 amino acid residues, such as 5, 6 or 7 amino acid residues; and/or (b) CDR2 has a length of between 13 and 24 amino acid residues, and usually between 15 and 21 amino acid residues, such as 16 and 17 amino acid residues; and/or (c) CDR3 has a length of between 2 and 35 amino acid residues, and usually between 3 and 30 amino acid residues, such as between 6 and 23 amino acid residues.

In another preferred, but non-limiting aspect, the invention relates to a Nanobody in which the CDR sequences (as defined herein) have more than 80%, preferably more than 90%, more preferably more than 95%, such as 99% or more sequence identity (as defined herein) with the CDR sequences of at least one of the amino acid sequences of SEQ ID NO's: 266-285.

Generally, Nanobodies with the above CDR sequences may be as further described herein, and preferably have framework sequences that are also as further described herein. Thus, for example and as mentioned herein, such Nanobodies may be naturally occurring Nanobodies (from any suitable species), naturally occurring $V_{HH}$ sequences (i.e. from a suitable species of Camelid) or synthetic or semi-synthetic amino acid sequences or Nanobodies, including but not limited to partially humanized Nanobodies or $V_{HH}$ sequences, fully humanized Nanobodies or $V_{HH}$ sequences, camelized heavy chain variable domain sequences, as well as Nanobodies that have been obtained by the techniques mentioned herein.

Thus, in one specific, but non-limiting aspect, the invention relates to a humanized Nanobody, which consists of 4 framework regions (FR1 to FR4 respectively) and 3 complementarity determining regions (CDR1 to CDR3 respectively), in which CDR1 to CDR3 are as defined herein and in which said humanized Nanobody comprises at least one humanizing substitution (as defined herein), and in particular at least one humanizing substitution in at least one of its framework sequences (as defined herein).

In another preferred, but non-limiting aspect, the invention relates to a Nanobody in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 266-285. This degree of amino acid identity can for example be determined by determining the degree of amino acid identity (in a manner described herein) between said Nanobody and one or more of the sequences of SEQ ID NO's: 266-285, in which the amino acid residues that form the framework regions are disregarded. Such Nanobodies can be as further described herein.

In another preferred, but non-limiting aspect, the invention relates to a Nanobody with an amino acid sequence that is chosen from the group consisting of SEQ ID NO's: 266-285 or from the group consisting of from amino acid sequences that have more than 80%, preferably more than 90%, more preferably more than 95%, such as 99% or more sequence identity (as defined herein) with at least one of the amino acid sequences of SEQ ID NO's: 266-285.

Another preferred, but non-limiting aspect of the invention relates to humanized variants of the Nanobodies of SEQ ID NO's: 266-285, that comprise, compared to the corresponding native $V_{HH}$ sequence, at least one humanizing substitution (as defined herein), and in particular at least one humanizing substitution in at least one of its framework sequences (as defined herein).

In another preferred but non-limiting aspect, the invention relates to a Nanobody (as defined herein) against PD-1, which consists of 4 framework regions (FR1 to FR4 respectively) and 3 complementarity determining regions (CDR1 to CDR3 respectively), in which:

CDR1 is chosen from the group consisting of:
a) the amino acid sequences of SEQ ID NO's: 317-321;
b) amino acid sequences that have at least 80% amino acid identity with at least one of the amino acid sequences of SEQ ID NO's: 317-321;
c) amino acid sequences that have 3, 2, or 1 amino acid difference with at least one of the amino acid sequences of SEQ ID NO's: 317-321;
and/or
CDR2 is chosen from the group consisting of:
d) the amino acid sequences of SEQ ID NO's: 327-331;
e) amino acid sequences that have at least 80% amino acid identity with at least one of the amino acid sequences of SEQ ID NO's: 327-331;

f) amino acid sequences that have 3, 2, or 1 amino acid difference with at least one of the amino acid sequences of SEQ ID NO's: 327-331;

and/or

CDR3 is chosen from the group consisting of:

g) the amino acid sequences of SEQ ID NO's: 337-341;

h) amino acid sequences that have at least 80% amino acid identity with at least one of the amino acid sequences of SEQ ID NO's: 337-341;

i) amino acid sequences that have 3, 2, or 1 amino acid difference with at least one of the amino acid sequences of SEQ ID NO's: 337-341;

or any suitable fragment of such an amino acid sequence.

In particular, according to this preferred but non-limiting aspect, the invention relates to a Nanobody (as defined herein) against PD-1, which consists of 4 framework regions (FR1 to FR4 respectively) and 3 complementarity determining regions (CDR1 to CDR3 respectively), in which:

CDR1 is chosen from the group consisting of:

a) the amino acid sequences of SEQ ID NO's: 317-321;

b) amino acid sequences that have at least 80% amino acid identity with at least one of the amino acid sequences of SEQ ID NO's: 317-321;

c) amino acid sequences that have 3, 2, or 1 amino acid difference with at least one of the amino acid sequences of SEQ ID NO's: 317-321;

and

CDR2 is chosen from the group consisting of:

d) the amino acid sequences of SEQ ID NO's: 327-331;

e) amino acid sequences that have at least 80% amino acid identity with at least one of the amino acid sequences of SEQ ID NO's: 327-331;

f) amino acid sequences that have 3, 2, or 1 amino acid difference with at least one of the amino acid sequences of SEQ ID NO's: 327-331;

and

CDR3 is chosen from the group consisting of:

g) the amino acid sequences of SEQ ID NO's: 337-341;

h) amino acid sequences that have at least 80% amino acid identity with at least one of the amino acid sequences of SEQ ID NO's: 337-341;

i) amino acid sequences that have 3, 2, or 1 amino acid difference with at least one of the amino acid sequences of SEQ ID NO's: 337-341;

or any suitable fragment of such an amino acid sequences.

As generally mentioned herein for the amino acid sequences of the invention, when a Nanobody of the invention contains one or more CDR1 sequences according to b) and/or c):

i) any amino acid substitution in such a CDR according to b) and/or c) is preferably, and compared to the corresponding CDR according to a), a conservative amino acid substitution (as defined herein);

and/or ii) the CDR according to b) and/or c) preferably only contains amino acid substitutions, and no amino acid deletions or insertions, compared to the corresponding CDR according to a);

and/or iii) the CDR according to b) and/or c) may be a CDR that is derived from a CDR according to a) by means of affinity maturation using one or more techniques of affinity maturation known per se.

Similarly, when a Nanobody of the invention contains one or more CDR2 sequences according to e) and/or f):

i) any amino acid substitution in such a CDR according to e) and/or f) is preferably, and compared to the corresponding CDR according to d), a conservative amino acid substitution (as defined herein);

and/or ii) the CDR according to e) and/or f) preferably only contains amino acid substitutions, and no amino acid deletions or insertions, compared to the corresponding CDR according to d);

and/or iii) the CDR according to e) and/or f) may be a CDR that is derived from a CDR according to d) by means of affinity maturation using one or more techniques of affinity maturation known per se.

Also, similarly, when a Nanobody of the invention contains one or more CDR3 sequences according to h) and/or i):

i) any amino acid substitution in such a CDR according to h) and/or i) is preferably, and compared to the corresponding CDR according to g), a conservative amino acid substitution (as defined herein);

and/or ii) the CDR according to h) and/or i) preferably only contains amino acid substitutions, and no amino acid deletions or insertions, compared to the corresponding CDR according to g);

and/or iii) the CDR according to h) and/or i) may be a CDR that is derived from a CDR according to g) by means of affinity maturation using one or more techniques of affinity maturation known per se.

It should be understood that the last three paragraphs generally apply to any Nanobody of the invention that comprises one or more CDR1 sequences, CDR2 sequences and/or CDR3 sequences according to b), c), e), f), h) or i), respectively.

Of the Nanobodies of the invention, Nanobodies comprising one or more of the CDR's explicitly listed above are particularly preferred; Nanobodies comprising two or more of the CDR's explicitly listed above are more particularly preferred; and Nanobodies comprising three of the CDR's explicitly listed above are most particularly preferred.

Some particularly preferred, but non-limiting combinations of CDR sequences, as well as preferred combinations of CDR sequences and framework sequences, are mentioned in Table A-1b below, which lists the CDR sequences and framework sequences that are present in a number of preferred (but non-limiting) Nanobodies of the invention. As will be clear to the skilled person, a combination of CDR1, CDR2 and CDR3 sequences that occur in the same clone (i.e. CDR1, CDR2 and CDR3 sequences that are mentioned on the same line in Table A-1b) will usually be preferred (although the invention in its broadest sense is not limited thereto, and also comprises other suitable combinations of the CDR sequences mentioned in Table A-1b). Also, a combination of CDR sequences and framework sequences that occur in the same clone (i.e. CDR sequences and framework sequences that are mentioned on the same line in Table A-1b) will usually be preferred (although the invention in its broadest sense is not limited thereto, and also comprises other suitable combinations of the CDR sequences and framework sequences mentioned in Table A-1b, as well as combinations of such CDR sequences and other suitable framework sequences, e.g. as further described herein).

Also, in the Nanobodies of the invention that comprise the combinations of CDR's mentioned in Table A-1b, each CDR can be replaced by a CDR chosen from the group consisting of amino acid sequences that have at least 80%, preferably at least 90%, more preferably at least 95%, even more preferably at least 99% sequence identity (as defined herein) with the mentioned CDR's; in which:

i) any amino acid substitution in such a CDR is preferably, and compared to the corresponding CDR sequence mentioned in Table A-1b, a conservative amino acid substitution (as defined herein);
and/or
ii) any such CDR sequence preferably only contains amino acid substitutions, and no amino acid deletions or insertions, compared to the corresponding CDR sequence mentioned in Table A-1b;
and/or
iii) any such CDR sequence is a CDR that is derived by means of a technique for affinity maturation known per se, and in particular starting from the corresponding CDR sequence mentioned in Table A-1b.

However, as will be clear to the skilled person, the (combinations of) CDR sequences, as well as (the combinations of) CDR sequences and framework sequences mentioned in Table A-1b will generally be preferred.

the invention bind to PD-1 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In particular, in the Nanobodies of the invention, at least the CDR3 sequence present is suitably chosen from the group consisting of the CDR3 sequences listed in Table A-1b or from the group of CDR3 sequences that have at least 80%, preferably at least 90%, more preferably at least 95%, even more preferably at least 99% sequence identity with at least one of the CDR3 sequences listed in Table A-1b; and/or from the group consisting of the CDR3 sequences that have 3, 2 or only 1 amino acid difference(s) with at least one of the CDR3 sequences listed in Table A-1b.

Preferably, in the Nanobodies of the invention, at least two of the CDR1, CDR2 and CDR3 sequences present are suitably chosen from the group consisting of the CDR1, CDR2 and CDR3 sequences, respectively, listed in Table A-1b or from the group consisting of CDR1, CDR2 and CDR3 sequences, respectively, that have at least 80%, preferably at TABLE A-1b Preferred combinations of CDR sequences, preferred combinations of framework sequences, and preferred combinations of framework and CDR sequences for Nanobodies against PD-1. ("ID" refers to the SEQ ID NO in the attached sequence listing)

| Clone | ID FR1 | ID CDR 1 | ID FR2 | ID CDR 2 | ID FR3 | ID CDR 3 | ID FR4 |
|---|---|---|---|---|---|---|---|
| 102C3 | 312 EVQLVESGGGL VQAGKSLRLSC AASGSIFS | 317 IHAMG | 322 WFRQAPG KEREFVA | 327 AITWSGGITY YEDSVKG | 332 RFTISRDNAKNTVYLQ MNSLKPEDTAIYYCAA | 337 DRAESSW YDY | 342 WGQGTQVTVSS |
| 102C12 | 313 EVQLVESGGGL VQAGGSLRLSC AASGSIAS | 318 IHAMG | 323 WFRQAPG KEREFVA | 328 VITWSGGITY YADSVKG | 333 RFTISRDNAKNTVYLQ MNSLKPEDTAIYYCAG | 338 DKHQSSW YDY | 343 WGQGTQVTVSS |
| 102E2 | 314 EVQLVESGGGL VQAGGSLRLSC AASGSISS | 319 IHAMG | 324 WFRQAPG KEREFVA | 329 AITWSGGITY YADSLKG | 334 RFTISRDNAKNTGYLQ MNSLKPEDTAIYYCAA | 339 DRAQSSW YDY | 344 WGQGTQVTVSS |
| 102E8 | 315 EVQLVESGGGL VQAGGSLGLSC AASGSIFS | 320 INAMA | 325 WFRQAPG KEREFVA | 330 LISWSGGST YYEDSVKG | 335 RFTISRDNAKNTVYLQ MNSLKPEDTAIYYCAA | 340 DRVDSNW YDY | 345 WGQGTQVTVSS |
| 102H12 | 316 EVQLVESGGGL VQAGGSLRLSC AASGRAFS | 321 SGTMG | 326 WFRRAPG KEREFVA | 331 SIPWSGGRIY YADSVKG | 336 RFTISRDNAQNTVYLQ MNSLKPEDTAVYYCAV | 341 KERSTGW DFAS | 346 WGQGTQVTVSS |

Thus, in the Nanobodies of the invention, at least one of the CDR1, CDR2 and CDR3 sequences present is suitably chosen from the group consisting of the CDR1, CDR2 and CDR3 sequences, respectively, listed in Table A-1b; or from the group of CDR1, CDR2 and CDR3 sequences, respectively, that have at least 80%, preferably at least 90%, more preferably at least 95%, even more preferably at least 99% "sequence identity" (as defined herein) with at least one of the CDR1, CDR2 and CDR3 sequences, respectively, listed in Table A-1b; and/or from the group consisting of the CDR1, CDR2 and CDR3 sequences, respectively, that have 3, 2 or only 1 "amino acid difference(s)" (as defined herein) with at least one of the CDR1, CDR2 and CDR3 sequences, respectively, listed in Table A-1b.

In this context, by "suitably chosen" is meant that, as applicable, a CDR1 sequence is chosen from suitable CDR1 sequences (i.e. as defined herein), a CDR2 sequence is chosen from suitable CDR2 sequences (i.e. as defined herein), and a CDR3 sequence is chosen from suitable CDR3 sequence (i.e. as defined herein), respectively. More in particular, the CDR sequences are preferably chosen such that the Nanobodies of least 90%, more preferably at least 95%, even more preferably at least 99% sequence identity with at least one of the CDR1, CDR2 and CDR3 sequences, respectively, listed in Table A-1b; and/or from the group consisting of the CDR1, CDR2 and CDR3 sequences, respectively, that have 3, 2 or only 1 "amino acid difference(s)" with at least one of the CDR1, CDR2 and CDR3 sequences, respectively, listed in Table A-1b.

In particular, in the Nanobodies of the invention, at least the CDR3 sequence present is suitably chosen from the group consisting of the CDR3 sequences listed in Table A-1b or from the group of CDR3 sequences that have at least 80%, preferably at least 90%, more preferably at least 95%, even more preferably at least 99% sequence identity with at least one of the CDR3 sequences listed in Table A-1b, respectively; and at least one of the CDR1 and CDR2 sequences present is suitably chosen from the group consisting of the CDR1 and CDR2 sequences, respectively, listed in Table A-1b or from the group of CDR1 and CDR2 sequences, respectively, that have at least 80%, preferably at least 90%, more preferably at least 95%, even more preferably at least 99% sequence identity with at least one of the CDR1 and CDR2 sequences, respectively, listed in Table A-1b; and/or from the group consisting of the CDR1 and CDR2 sequences, respectively, that have 3, 2 or only 1 amino acid difference(s) with at least one of the CDR1 and CDR2 sequences, respectively, listed in Table A-1b.

Most preferably, in the Nanobodies of the invention, all three CDR1, CDR2 and CDR3 sequences present are suitably chosen from the group consisting of the CDR1, CDR2 and CDR3 sequences, respectively, listed in Table A-1b or from the group of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table A-1b; and/or from the group consisting of the CDR1, CDR2 and CDR3 sequences, respectively, that have 3, 2 or only 1 amino acid difference(s) with at least one of the CDR1, CDR2 and CDR3 sequences, respectively, listed in Table A-1b.

Even more preferably, in the Nanobodies of the invention, at least one of the CDR1, CDR2 and CDR3 sequences present is suitably chosen from the group consisting of the CDR1, CDR2 and CDR3 sequences, respectively, listed in Table A-1b. Preferably, in this aspect, at least one or preferably both of the other two CDR sequences present are suitably chosen from CDR sequences that have at least 80%, preferably at least 90%, more preferably at least 95%, even more preferably at least 99% sequence identity with at least one of the corresponding CDR sequences, respectively, listed in Table A-1b; and/or from the group consisting of the CDR sequences that have 3, 2 or only 1 amino acid difference(s) with at least one of the corresponding sequences, respectively, listed in Table A-1b.

In particular, in the Nanobodies of the invention, at least the CDR3 sequence present is suitably chosen from the group consisting of the CDR3 listed in Table A-1b. Preferably, in this aspect, at least one and preferably both of the CDR1 and CDR2 sequences present are suitably chosen from the groups of CDR1 and CDR2 sequences, respectively, that have at least 80%, preferably at least 90%, more preferably at least 95%, even more preferably at least 99% sequence identity with the CDR1 and CDR2 sequences, respectively, listed in Table A-1b; and/or from the group consisting of the CDR1 and CDR2 sequences, respectively, that have 3, 2 or only 1 amino acid difference(s) with at least one of the CDR1 and CDR2 sequences, respectively, listed in Table A-1b.

Even more preferably, in the Nanobodies of the invention, at least two of the CDR1, CDR2 and CDR3 sequences present are suitably chosen from the group consisting of the CDR1, CDR2 and CDR3 sequences, respectively, listed in Table A-1b. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table A-1b; and/or from the group consisting of CDR sequences that have 3, 2 or only 1 amino acid difference(s) with at least one of the corresponding sequences listed in Table A-1b.

In particular, in the Nanobodies of the invention, at least the CDR3 sequence is suitably chosen from the group consisting of the CDR3 sequences listed in Table A-1b, and either the CDR1 sequence or the CDR2 sequence is suitably chosen from the group consisting of the CDR1 and CDR2 sequences, respectively, listed in Table A-1b. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table A-1b; and/or from the group consisting of CDR sequences that have 3, 2 or only 1 amino acid difference(s) with the corresponding CDR sequences listed in Table A-1b.

Even more preferably, in the Nanobodies of the invention, all three CDR1, CDR2 and CDR3 sequences present are suitably chosen from the group consisting of the CDR1, CDR2 and CDR3 sequences, respectively, listed in Table A-1b.

Also, generally, the combinations of CDR's listed in Table A-1b (i.e. those mentioned on the same line in Table A-1b) are preferred. Thus, it is generally preferred that, when a CDR in a Nanobody of the invention is a CDR sequence mentioned in Table A-1b or is suitably chosen from the group of CDR sequences that have at least 80%, preferably at least 90%, more preferably at least 95%, even more preferably at least 99% sequence identity with a CDR sequence listed in Table A-1b; and/or from the group consisting of CDR sequences that have 3, 2 or only 1 amino acid difference(s) with a CDR sequence listed in Table A-1b, that at least one and preferably both of the other CDR's are suitably chosen from the CDR sequences that belong to the same combination in Table A-1b (i.e. mentioned on the same line in Table A-1b) or are suitably chosen from the group of CDR sequences that have at least 80%, preferably at least 90%, more preferably at least 95%, even more preferably at least 99% sequence identity with the CDR sequence(s) belonging to the same combination and/or from the group consisting of CDR sequences that have 3, 2 or only 1 amino acid difference(s) with the CDR sequence(s) belonging to the same combination. The other preferences indicated in the above paragraphs also apply to the combinations of CDR's mentioned in Table A-1b.

Thus, by means of non-limiting examples, a Nanobody of the invention can for example comprise a CDR1 sequence that has more than 80% sequence identity with one of the CDR1 sequences mentioned in Table A-1b, a CDR2 sequence that has 3, 2 or 1 amino acid difference with one of the CDR2 sequences mentioned in Table A-1b (but belonging to a different combination), and a CDR3 sequence.

Some preferred Nanobodies of the invention may for example comprise: (1) a CDR1 sequence that has more than 80% sequence identity with one of the CDR1 sequences mentioned in Table A-1b; a CDR2 sequence that has 3, 2 or 1 amino acid difference with one of the CDR2 sequences mentioned in Table A-1b (but belonging to a different combination); and a CDR3 sequence that has more than 80% sequence identity with one of the CDR3 sequences mentioned in Table A-1b (but belonging to a different combination); or (2) a CDR1 sequence that has more than 80% sequence identity with one of the CDR1 sequences mentioned in Table A-1b; a CDR2 sequence, and one of the CDR3 sequences listed in Table A-1b; or (3) a CDR1 sequence; a CDR2 sequence that has more than 80% sequence identity with one of the CDR2 sequence listed in Table A-1b; and a CDR3 sequence that has 3, 2 or 1 amino acid differences with the CDR3 sequence mentioned in Table A-1b that belongs to the same combination as the CDR2 sequence.

Some particularly preferred Nanobodies of the invention may for example comprise: (1) a CDR1 sequence that has more than 80% sequence identity with one of the CDR1 sequences mentioned in Table A-1b; a CDR2 sequence that has 3, 2 or 1 amino acid difference with the CDR2 sequence mentioned in Table A-1b that belongs to the same combination; and a CDR3 sequence that has more than 80% sequence identity with the CDR3 sequence mentioned in Table A-1b that belongs to the same combination; (2) a CDR1 sequence; a CDR 2 listed in Table A-1b and a CDR3 sequence listed in Table A-1b (in which the CDR2 sequence and CDR3 sequence may belong to different combinations).

Some even more preferred Nanobodies of the invention may for example comprise: (1) a CDR1 sequence that has more than 80% sequence identity with one of the CDR1 sequences mentioned in Table A-1b; the CDR2 sequence listed in Table A-1b that belongs to the same combination; and a CDR3 sequence mentioned in Table A-1b that belongs to a different combination; or (2) a CDR1 sequence mentioned in Table A-1b; a CDR2 sequence that has 3, 2 or 1 amino acid differences with the CDR2 sequence mentioned in Table A-1b that belongs to the same combination; and a CDR3 sequence that has more than 80% sequence identity with the CDR3 sequence listed in Table A-1b that belongs to the same or a different combination.

Particularly preferred Nanobodies of the invention may for example comprise a CDR1 sequence mentioned in Table A-1b, a CDR2 sequence that has more than 80% sequence identity with the CDR2 sequence mentioned in Table A-1b that belongs to the same combination; and the CDR3 sequence mentioned in Table A-1b that belongs to the same combination.

In the most preferred Nanobodies of the invention, the CDR1, CDR2 and CDR3 sequences present are suitably chosen from one of the combinations of CDR1, CDR2 and CDR3 sequences, respectively, listed in Table A-1b.

According to another preferred, but non-limiting aspect of the invention (a) CDR1 has a length of between 1 and 12 amino acid residues, and usually between 2 and 9 amino acid residues, such as 5, 6 or 7 amino acid residues; and/or (b) CDR2 has a length of between 13 and 24 amino acid residues, and usually between 15 and 21 amino acid residues, such as 16 and 17 amino acid residues; and/or (c) CDR3 has a length of between 2 and 35 amino acid residues, and usually between 3 and 30 amino acid residues, such as between 6 and 23 amino acid residues.

In another preferred, but non-limiting aspect, the invention relates to a Nanobody in which the CDR sequences (as defined herein) have more than 80%, preferably more than 90%, more preferably more than 95%, such as 99% or more sequence identity (as defined herein) with the CDR sequences of at least one of the amino acid sequences of SEQ ID NO's: 347-351.

Generally, Nanobodies with the above CDR sequences may be as further described herein, and preferably have framework sequences that are also as further described herein. Thus, for example and as mentioned herein, such Nanobodies may be naturally occurring Nanobodies (from any suitable species), naturally occurring $V_{HH}$ sequences (i.e. from a suitable species of Camelid) or synthetic or semi-synthetic amino acid sequences or Nanobodies, including but not limited to partially humanized Nanobodies or $V_{HH}$ sequences, fully humanized Nanobodies or $V_{HH}$ sequences, camelized heavy chain variable domain sequences, as well as Nanobodies that have been obtained by the techniques mentioned herein.

Thus, in one specific, but non-limiting aspect, the invention relates to a humanized Nanobody, which consists of 4 framework regions (FR1 to FR4 respectively) and 3 complementarity determining regions (CDR1 to CDR3 respectively), in which CDR1 to CDR3 are as defined herein and in which said humanized Nanobody comprises at least one humanizing substitution (as defined herein), and in particular at least one humanizing substitution in at least one of its framework sequences (as defined herein).

In another preferred, but non-limiting aspect, the invention relates to a Nanobody in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 347-351. This degree of amino acid identity can for example be determined by determining the degree of amino acid identity (in a manner described herein) between said Nanobody and one or more of the sequences of SEQ ID NO's: 347-351, in which the amino acid residues that form the framework regions are disregarded. Such Nanobodies can be as further described herein.

In another preferred, but non-limiting aspect, the invention relates to a Nanobody with an amino acid sequence that is chosen from the group consisting of SEQ ID NO's: 347-351 or from the group consisting of from amino acid sequences that have more than 80%, preferably more than 90%, more preferably more than 95%, such as 99% or more sequence identity (as defined herein) with at least one of the amino acid sequences of SEQ ID NO's: 347-351.

Another preferred, but non-limiting aspect of the invention relates to humanized variants of the Nanobodies of SEQ ID NO's: 347-351, that comprise, compared to the corresponding native $V_{HH}$ sequence, at least one humanizing substitution (as defined herein), and in particular at least one humanizing substitution in at least one of its framework sequences (as defined herein).

In another preferred but non-limiting aspect, the invention relates to a Nanobody (as defined herein) against PD-L1, which consists of 4 framework regions (FR1 to FR4 respectively) and 3 complementarity determining regions (CDR1 to CDR3 respectively), in which:

CDR1 is chosen from the group consisting of:
a) the amino acid sequences of SEQ ID NO's: 358-363;
b) amino acid sequences that have at least 80% amino acid identity with at least one of the amino acid sequences of SEQ ID NO's: 358-363;
c) amino acid sequences that have 3, 2, or 1 amino acid difference with at least one of the amino acid sequences of SEQ ID NO's: 358-363;
and/or
CDR2 is chosen from the group consisting of:
d) the amino acid sequences of SEQ ID NO's: 370-375;
e) amino acid sequences that have at least 80% amino acid identity with at least one of the amino acid sequences of SEQ ID NO's: 370-375;
f) amino acid sequences that have 3, 2, or 1 amino acid difference with at least one of the amino acid sequences of SEQ ID NO's: 370-375;
and/or
CDR3 is chosen from the group consisting of:
g) the amino acid sequences of SEQ ID NO's: 382-387;
h) amino acid sequences that have at least 80% amino acid identity with at least one of the amino acid sequences of SEQ ID NO's: 382-387;
i) amino acid sequences that have 3, 2, or 1 amino acid difference with at least one of the amino acid sequences of SEQ ID NO's: 382-387;
or any suitable fragment of such an amino acid sequence.

In particular, according to this preferred but non-limiting aspect, the invention relates to a Nanobody (as defined herein) against PD-L1, which consists of 4 framework regions (FR1 to FR4 respectively) and 3 complementarity determining regions (CDR1 to CDR3 respectively), in which:

CDR1 is chosen from the group consisting of:
a) the amino acid sequences of SEQ ID NO's: 358-363;
b) amino acid sequences that have at least 80% amino acid identity with at least one of the amino acid sequences of SEQ ID NO's: 358-363;
c) amino acid sequences that have 3, 2, or 1 amino acid difference with at least one of the amino acid sequences of SEQ ID NO's: 358-363;
and
CDR2 is chosen from the group consisting of:
d) the amino acid sequences of SEQ ID NO's: 370-375;
e) amino acid sequences that have at least 80% amino acid identity with at least one of the amino acid sequences of SEQ ID NO's: 370-375;
f) amino acid sequences that have 3, 2, or 1 amino acid difference with at least one of the amino acid sequences of SEQ ID NO's: 370-375;
and
CDR3 is chosen from the group consisting of:
g) the amino acid sequences of SEQ ID NO's: 382-387;
h) amino acid sequences that have at least 80% amino acid identity with at least one of the amino acid sequences of SEQ ID NO's: 382-387;
i) amino acid sequences that have 3, 2, or 1 amino acid difference with at least one of the amino acid sequences of SEQ ID NO's: 382-387;
or any suitable fragment of such an amino acid sequences.

As generally mentioned herein for the amino acid sequences of the invention, when a Nanobody of the invention contains one or more CDR1 sequences according to b) and/or c):
i) any amino acid substitution in such a CDR according to b) and/or c) is preferably, and compared to the corresponding CDR according to a), a conservative amino acid substitution (as defined herein);
and/or
ii) the CDR according to b) and/or c) preferably only contains amino acid substitutions, and no amino acid deletions or insertions, compared to the corresponding CDR according to a);
and/or
iii) the CDR according to b) and/or c) may be a CDR that is derived from a CDR according to a) by means of affinity maturation using one or more techniques of affinity maturation known per se.

Similarly, when a Nanobody of the invention contains one or more CDR2 sequences according to e) and/or f):
i) any amino acid substitution in such a CDR according to e) and/or f) is preferably, and compared to the corresponding CDR according to d), a conservative amino acid substitution (as defined herein);
and/or
ii) the CDR according to e) and/or f) preferably only contains amino acid substitutions, and no amino acid deletions or insertions, compared to the corresponding CDR according to d);
and/or
iii) the CDR according to e) and/or f) may be a CDR that is derived from a CDR according to d) by means of affinity maturation using one or more techniques of affinity maturation known per se.

Also, similarly, when a Nanobody of the invention contains one or more CDR3 sequences according to h) and/or i):
i) any amino acid substitution in such a CDR according to h) and/or i) is preferably, and compared to the corresponding CDR according to g), a conservative amino acid substitution (as defined herein);
and/or
ii) the CDR according to h) and/or i) preferably only contains amino acid substitutions, and no amino acid deletions or insertions, compared to the corresponding CDR according to g);
and/or
iii) the CDR according to h) and/or i) may be a CDR that is derived from a CDR according to g) by means of affinity maturation using one or more techniques of affinity maturation known per se.

It should be understood that the last three paragraphs generally apply to any Nanobody of the invention that comprises one or more CDR1 sequences, CDR2 sequences and/or CDR3 sequences according to b), c), e), f), h) or i), respectively.

Of the Nanobodies of the invention, Nanobodies comprising one or more of the CDR's explicitly listed above are particularly preferred; Nanobodies comprising two or more of the CDR's explicitly listed above are more particularly preferred; and Nanobodies comprising three of the CDR's explicitly listed above are most particularly preferred.

Some particularly preferred, but non-limiting combinations of CDR sequences, as well as preferred combinations of CDR sequences and framework sequences, are mentioned in Table A-1c below, which lists the CDR sequences and framework sequences that are present in a number of preferred (but non-limiting) Nanobodies of the invention. As will be clear to the skilled person, a combination of CDR1, CDR2 and CDR3 sequences that occur in the same clone (i.e. CDR1, CDR2 and CDR3 sequences that are mentioned on the same line in Table A-1c) will usually be preferred (although the invention in its broadest sense is not limited thereto, and also comprises other suitable combinations of the CDR sequences mentioned in Table A-1c). Also, a combination of CDR sequences and framework sequences that occur in the same clone (i.e. CDR sequences and framework sequences that are mentioned on the same line in Table A-1c) will usually be preferred (although the invention in its broadest sense is not limited thereto, and also comprises other suitable combinations of the CDR sequences and framework sequences mentioned in Table A-1c, as well as combinations of such CDR sequences and other suitable framework sequences, e.g. as further described herein).

Also, in the Nanobodies of the invention that comprise the combinations of CDR's mentioned in Table A-1c, each CDR can be replaced by a CDR chosen from the group consisting of amino acid sequences that have at least 80%, preferably at least 90%, more preferably at least 95%, even more preferably at least 99% sequence identity (as defined herein) with the mentioned CDR's; in which:
i) any amino acid substitution in such a CDR is preferably, and compared to the corresponding CDR sequence mentioned in Table A-1c, a conservative amino acid substitution (as defined herein);
and/or
ii) any such CDR sequence preferably only contains amino acid substitutions, and no amino acid deletions or insertions, compared to the corresponding CDR sequence mentioned in Table A-1c;
and/or
iii) any such CDR sequence is a CDR that is derived by means of a technique for affinity maturation known per se, and in particular starting from the corresponding CDR sequence mentioned in Table A-1c.

However, as will be clear to the skilled person, the (combinations of) CDR sequences, as well as (the combinations of) CDR sequences and framework sequences mentioned in Table A-1c will generally be preferred.

Preferably, in the Nanobodies of the invention, at least two of the CDR1, CDR2 and CDR3 sequences present are suit-

TABLE A-1C

Preferred combinations of CDR sequences, preferred combinations of framework sequences, and preferred combinations of framework and CDR sequences for Nanobodies against PD-L1. ("ID" refers to the SEQ ID NO in the attached sequence listing)

| Clone | ID | FR1 | ID | CDR 1 | ID | FR2 | ID | CDR 2 | ID | FR3 | ID | CDR 3 | ID | FR4 |
|---|---|---|---|---|---|---|---|---|---|---|---|---|---|---|
| 104D2 | 352 | EVQLVESGGGL VQPGGSLRLSC AASGFTLD | 358 | YYAIG | 364 | WFRQAPG KEREWAS | 370 | SISSSDGSTY YADSVKG | 376 | RFTISRDNAKNTVFLQ MNSLKPEDTAVYSCAA | 382 | SQAPITIAT MMKPFYDY | 388 | WGQGT QVTVSS |
| 104F5 | 353 | EVQLVESGGGL VQPGGSLRLSC AASGFTLD | 359 | YYAKC | 365 | WFRQAPG KEREWVS | 371 | CISSSDGSTY YADSVKG | 377 | RFTISRDNAKNTVYLQ MNSLKPEDTAVYFCAA | 383 | RHGGPLT VEYFFDY | 389 | WGQGT QVTVSS |
| 104E12 | 354 | EVQLVESGGGL VQPGGSLRLSC AASGFTFD | 360 | YYAIG | 366 | WFRQAPG KAREGVS | 372 | CISGGDNST YYADSVKG | 378 | RFTISRDNAKNTVYLQ MNSLKPEDTAVYYCAT | 384 | GGWKYCS GYDPEYIY | 390 | WGQGT QVTVSS |
| 104B10 | 355 | EVQLVESGGGL VQAGGSLRLSC AASGSTFS | 361 | QYDVG | 367 | WYRQAPG KQRELVA | 373 | FSSSGGRTIY PDSVKG | 379 | RFTFSRDNTKNTVYLQ MTSLKPEDTAVYYCKI | 385 | DWYLNSY | 391 | WGQGT QVTVSS |
| 104F10 | 356 | EVQLVESGGGL VQAGGSLRLSC AASGVDAS | 362 | NSAMG | 368 | WYRQAPG KQREWVA | 374 | RITGGGLIAY TDSVKG | 380 | RFTISRDNAKSTVYLQ MNSLEPEDTAVYYCNT | 386 | INSRDG | 392 | WGQGT QVTVSS |
| 104D7 | 357 | EVQLVESGGGL VQAGGSLTISC AASGITFS | 363 | DSIVS | 369 | WYRRARG KQREWVA | 375 | GISNGGTTK YAESVLG | 381 | RFTISRDNAKNMVYLQ MNGLNPEDTAVYLCKV | 387 | RQY | 393 | WGQGT QVTVSS |

Thus, in the Nanobodies of the invention, at least one of the CDR1, CDR2 and CDR3 sequences present is suitably chosen from the group consisting of the CDR1, CDR2 and CDR3 sequences, respectively, listed in Table A-1c; or from the group of CDR1, CDR2 and CDR3 sequences, respectively, that have at least 80%, preferably at least 90%, more preferably at least 95%, even more preferably at least 99% "sequence identity" (as defined herein) with at least one of the CDR1, CDR2 and CDR3 sequences, respectively, listed in Table A-1c; and/or from the group consisting of the CDR1, CDR2 and CDR3 sequences, respectively, that have 3, 2 or only 1 "amino acid difference(s)" (as defined herein) with at least one of the CDR1, CDR2 and CDR3 sequences, respectively, listed in Table A-1c.

In this context, by "suitably chosen" is meant that, as applicable, a CDR1 sequence is chosen from suitable CDR1 sequences (i.e. as defined herein), a CDR2 sequence is chosen from suitable CDR2 sequences (i.e. as defined herein), and a CDR3 sequence is chosen from suitable CDR3 sequence (i.e. as defined herein), respectively. More in particular, the CDR sequences are preferably chosen such that the Nanobodies of the invention bind to PD-L1 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In particular, in the Nanobodies of the invention, at least the CDR3 sequence present is suitably chosen from the group consisting of the CDR3 sequences listed in Table A-1c or from the group of CDR3 sequences that have at least 80%, preferably at least 90%, more preferably at least 95%, even more preferably at least 99% sequence identity with at least one of the CDR3 sequences listed in Table A-1c, respectively; and/or from the group consisting of the CDR3 sequences that have 3, 2 or only 1 amino acid difference(s) with at least one of the CDR3 sequences listed in Table A-1c.

ably chosen from the group consisting of the CDR1, CDR2 and CDR3 sequences, respectively, listed in Table A-1c or from the group consisting of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table A-1c; and/or from the group consisting of the CDR1, CDR2 and CDR3 sequences, respectively, that have 3, 2 or only 1 "amino acid difference(s)" with at least one of the CDR1, CDR2 and CDR3 sequences, respectively, listed in Table A-1c.

In particular, in the Nanobodies of the invention, at least the CDR3 sequence present is suitably chosen from the group consisting of the CDR3 sequences listed in Table A-1c or from the group of CDR3 sequences that have at least 80%, preferably at least 90%, more preferably at least 95%, even more preferably at least 99% sequence identity with at least one of the CDR3 sequences listed in Table A-1c, respectively; and at least one of the CDR1 and CDR2 sequences present is suitably chosen from the group consisting of the CDR1 and CDR2 sequences, respectively, listed in Table A-1c or from the group of CDR1 and CDR2 sequences, respectively, that have at least 80%, preferably at least 90%, more preferably at least 95%, even more preferably at least 99% sequence identity with at least one of the CDR1 and CDR2 sequences, respectively, listed in Table A-1c; and/or from the group consisting of the CDR1 and CDR2 sequences, respectively, that have 3, 2 or only 1 amino acid difference(s) with at least one of the CDR1 and CDR2 sequences, respectively, listed in Table A-1c.

Most preferably, in the Nanobodies of the invention, all three CDR1, CDR2 and CDR3 sequences present are suitably chosen from the group consisting of the CDR1, CDR2 and CDR3 sequences, respectively, listed in Table A-1c or from the group of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table A-1c; and/or from the group consisting of the CDR1, CDR2 and CDR3 sequences, respectively, that have 3, 2 or only 1 amino acid difference(s) with at least one of the CDR1, CDR2 and CDR3 sequences, respectively, listed in Table A-1c.

Even more preferably, in the Nanobodies of the invention, at least one of the CDR1, CDR2 and CDR3 sequences present is suitably chosen from the group consisting of the CDR1, CDR2 and CDR3 sequences, respectively, listed in Table A-1c. Preferably, in this aspect, at least one or preferably both of the other two CDR sequences present are suitably chosen from CDR sequences that have at least 80%, preferably at least 90%, more preferably at least 95%, even more preferably at least 99% sequence identity with at least one of the corresponding CDR sequences, respectively, listed in Table A-1c; and/or from the group consisting of the CDR sequences that have 3, 2 or only 1 amino acid difference(s) with at least one of the corresponding sequences, respectively, listed in Table A-1c.

In particular, in the Nanobodies of the invention, at least the CDR3 sequence present is suitably chosen from the group consisting of the CDR3 listed in Table A-1c. Preferably, in this aspect, at least one and preferably both of the CDR1 and CDR2 sequences present are suitably chosen from the groups of CDR1 and CDR2 sequences, respectively, that have at least 80%, preferably at least 90%, more preferably at least 95%, even more preferably at least 99% sequence identity with the CDR1 and CDR2 sequences, respectively, listed in Table A-1c; and/or from the group consisting of the CDR1 and CDR2 sequences, respectively, that have 3, 2 or only 1 amino acid difference(s) with at least one of the CDR1 and CDR2 sequences, respectively, listed in Table A-1c.

Even more preferably, in the Nanobodies of the invention, at least two of the CDR1, CDR2 and CDR3 sequences present are suitably chosen from the group consisting of the CDR1, CDR2 and CDR3 sequences, respectively, listed in Table A-1c. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table A-1c; and/or from the group consisting of CDR sequences that have 3, 2 or only 1 amino acid difference(s) with at least one of the corresponding sequences listed in Table A-1c.

In particular, in the Nanobodies of the invention, at least the CDR3 sequence is suitably chosen from the group consisting of the CDR3 sequences listed in Table A-1c, and either the CDR1 sequence or the CDR2 sequence is suitably chosen from the group consisting of the CDR1 and CDR2 sequences, respectively, listed in Table A-1c. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table A-1c; and/or from the group consisting of CDR sequences that have 3, 2 or only 1 amino acid difference(s) with the corresponding CDR sequences listed in Table A-1c.

Even more preferably, in the Nanobodies of the invention, all three CDR1, CDR2 and CDR3 sequences present are suitably chosen from the group consisting of the CDR1, CDR2 and CDR3 sequences, respectively, listed in Table A-1c.

Also, generally, the combinations of CDR's listed in Table A-1c (i.e. those mentioned on the same line in Table A-1c) are preferred. Thus, it is generally preferred that, when a CDR in a Nanobody of the invention is a CDR sequence mentioned in Table A-1c or is suitably chosen from the group of CDR sequences that have at least 80%, preferably at least 90%, more preferably at least 95%, even more preferably at least 99% sequence identity with a CDR sequence listed in Table A-1c; and/or from the group consisting of CDR sequences that have 3, 2 or only 1 amino acid difference(s) with a CDR sequence listed in Table A-1c, that at least one and preferably both of the other CDR's are suitably chosen from the CDR sequences that belong to the same combination in Table A-1c (i.e. mentioned on the same line in Table A-1c) or are suitably chosen from the group of CDR sequences that have at least 80%, preferably at least 90%, more preferably at least 95%, even more preferably at least 99% sequence identity with the CDR sequence(s) belonging to the same combination and/or from the group consisting of CDR sequences that have 3, 2 or only 1 amino acid difference(s) with the CDR sequence(s) belonging to the same combination. The other preferences indicated in the above paragraphs also apply to the combinations of CDR's mentioned in Table A-1c.

Thus, by means of non-limiting examples, a Nanobody of the invention can for example comprise a CDR1 sequence that has more than 80% sequence identity with one of the CDR1 sequences mentioned in Table A-1c, a CDR2 sequence that has 3, 2 or 1 amino acid difference with one of the CDR2 sequences mentioned in Table A-1c (but belonging to a different combination), and a CDR3 sequence.

Some preferred Nanobodies of the invention may for example comprise: (1) a CDR1 sequence that has more than 80% sequence identity with one of the CDR1 sequences mentioned in Table A-1c; a CDR2 sequence that has 3, 2 or 1 amino acid difference with one of the CDR2 sequences mentioned in Table A-1c (but belonging to a different combination); and a CDR3 sequence that has more than 80% sequence identity with one of the CDR3 sequences mentioned in Table A-1c (but belonging to a different combination); or (2) a CDR1 sequence that has more than 80% sequence identity with one of the CDR1 sequences mentioned in Table A-1c; a CDR2 sequence, and one of the CDR3 sequences listed in Table A-1c; or (3) a CDR1 sequence; a CDR2 sequence that has more than 80% sequence identity with one of the CDR2 sequence listed in Table A-1c; and a CDR3 sequence that has 3, 2 or 1 amino acid differences with the CDR3 sequence mentioned in Table A-1c that belongs to the same combination as the CDR2 sequence.

Some particularly preferred Nanobodies of the invention may for example comprise: (1) a CDR1 sequence that has more than 80% sequence identity with one of the CDR1 sequences mentioned in Table A-1c; a CDR2 sequence that has 3, 2 or 1 amino acid difference with the CDR2 sequence mentioned in Table A-1c that belongs to the same combination; and a CDR3 sequence that has more than 80% sequence identity with the CDR3 sequence mentioned in Table A-1c that belongs to the same combination; (2) a CDR1 sequence; a CDR 2 listed in Table A-1c and a CDR3 sequence listed in Table A-1c (in which the CDR2 sequence and CDR3 sequence may belong to different combinations).

Some even more preferred Nanobodies of the invention may for example comprise: (1) a CDR1 sequence that has more than 80% sequence identity with one of the CDR1 sequences mentioned in Table A-1c; the CDR2 sequence listed in Table A-1c that belongs to the same combination; and a CDR3 sequence mentioned in Table A-1c that belongs to a different combination; or (2) a CDR1 sequence mentioned in Table A-1c; a CDR2 sequence that has 3, 2 or 1 amino acid differences with the CDR2 sequence mentioned in Table A-1c that belongs to the same combination; and a CDR3 sequence that has more than 80% sequence identity with the CDR3 sequence listed in Table A-1c that belongs to the same or a different combination.

Particularly preferred Nanobodies of the invention may for example comprise a CDR1 sequence mentioned in Table A-1c, a CDR2 sequence that has more than 80% sequence identity with the CDR2 sequence mentioned in Table A-1c that belongs to the same combination; and the CDR3 sequence mentioned in Table A-1c that belongs to the same combination.

In the most preferred Nanobodies of the invention, the CDR1, CDR2 and CDR3 sequences present are suitably chosen from one of the combinations of CDR1, CDR2 and CDR3 sequences, respectively, listed in Table A-1c.

According to another preferred, but non-limiting aspect of the invention (a) CDR1 has a length of between 1 and 12 amino acid residues, and usually between 2 and 9 amino acid residues, such as 5, 6 or 7 amino acid residues; and/or (b) CDR2 has a length of between 13 and 24 amino acid residues, and usually between 15 and 21 amino acid residues, such as 16 and 17 amino acid residues; and/or (c) CDR3 has a length of between 2 and 35 amino acid residues, and usually between 3 and 30 amino acid residues, such as between 6 and 23 amino acid residues.

In another preferred, but non-limiting aspect, the invention relates to a Nanobody in which the CDR sequences (as defined herein) have more than 80%, preferably more than 90%, more preferably more than 95%, such as 99% or more sequence identity (as defined herein) with the CDR sequences of at least one of the amino acid sequences of SEQ ID NO's: 394-399.

Generally, Nanobodies with the above CDR sequences may be as further described herein, and preferably have framework sequences that are also as further described herein. Thus, for example and as mentioned herein, such Nanobodies may be naturally occurring Nanobodies (from any suitable species), naturally occurring $V_{HH}$ sequences (i.e. from a suitable species of Camelid) or synthetic or semi-synthetic amino acid sequences or Nanobodies, including but not limited to partially humanized Nanobodies or $V_{HH}$ sequences, fully humanized Nanobodies or $V_{HH}$ sequences, camelized heavy chain variable domain sequences, as well as Nanobodies that have been obtained by the techniques mentioned herein.

Thus, in one specific, but non-limiting aspect, the invention relates to a humanized Nanobody, which consists of 4 framework regions (FR1 to FR4 respectively) and 3 complementarity determining regions (CDR1 to CDR3 respectively), in which CDR1 to CDR3 are as defined herein and in which said humanized Nanobody comprises at least one humanizing substitution (as defined herein), and in particular at least one humanizing substitution in at least one of its framework sequences (as defined herein).

In another preferred, but non-limiting aspect, the invention relates to a Nanobody in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 394-399. This degree of amino acid identity can for example be determined by determining the degree of amino acid identity (in a manner described herein) between said Nanobody and one or more of the sequences of SEQ ID NO's: 394-399, in which the amino acid residues that form the framework regions are disregarded. Such Nanobodies can be as further described herein.

In another preferred, but non-limiting aspect, the invention relates to a Nanobody with an amino acid sequence that is chosen from the group consisting of SEQ ID NO's: 394-399 or from the group consisting of from amino acid sequences that have more than 80%, preferably more than 90%, more preferably more than 95%, such as 99% or more sequence identity (as defined herein) with at least one of the amino acid sequences of SEQ ID NO's: 394-399.

Another preferred, but non-limiting aspect of the invention relates to humanized variants of the Nanobodies of SEQ ID NO's: 394-399, that comprise, compared to the corresponding native $V_{HH}$ sequence, at least one humanizing substitution (as defined herein), and in particular at least one humanizing substitution in at least one of its framework sequences (as defined herein).

In another preferred but non-limiting aspect, the invention relates to a Nanobody (as defined herein) against PD-L2, which consists of 4 framework regions (FR1 to FR4 respectively) and 3 complementarity determining regions (CDR1 to CDR3 respectively), in which:

CDR1 is chosen from the group consisting of:

a) the amino acid sequences of SEQ ID NO's: 407-413;

b) amino acid sequences that have at least 80% amino acid identity with at least one of the amino acid sequences of SEQ ID NO's: 407-413;

c) amino acid sequences that have 3, 2, or 1 amino acid difference with at least one of the amino acid sequences of SEQ ID NO's: 407-413;

and/or

CDR2 is chosen from the group consisting of:

d) the amino acid sequences of SEQ ID NO's: 421-427;

e) amino acid sequences that have at least 80% amino acid identity with at least one of the amino acid sequences of SEQ ID NO's: 421-427;

f) amino acid sequences that have 3, 2, or 1 amino acid difference with at least one of the amino acid sequences of SEQ ID NO's: 421-427;

and/or

CDR3 is chosen from the group consisting of:

g) the amino acid sequences of SEQ ID NO's: 435-441;

h) amino acid sequences that have at least 80% amino acid identity with at least one of the amino acid sequences of SEQ ID NO's: 435-441;

i) amino acid sequences that have 3, 2, or 1 amino acid difference with at least one of the amino acid sequences of SEQ ID NO's: 435-441;

or any suitable fragment of such an amino acid sequence.

In particular, according to this preferred but non-limiting aspect, the invention relates to a Nanobody (as defined herein) against PD-L1, which consists of 4 framework regions (FR1 to FR4 respectively) and 3 complementarity determining regions (CDR1 to CDR3 respectively), in which:

CDR1 is chosen from the group consisting of:

a) the amino acid sequences of SEQ ID NO's: 407-413;

b) amino acid sequences that have at least 80% amino acid identity with at least one of the amino acid sequences of SEQ ID NO's: 407-413;

c) amino acid sequences that have 3, 2, or 1 amino acid difference with at least one of the amino acid sequences of SEQ ID NO's: 407-413;
and
CDR2 is chosen from the group consisting of:
d) the amino acid sequences of SEQ ID NO's: 421-427;
e) amino acid sequences that have at least 80% amino acid identity with at least one of the amino acid sequences of SEQ ID NO's: 421-427;
f) amino acid sequences that have 3, 2, or 1 amino acid difference with at least one of the amino acid sequences of SEQ ID NO's: 421-427;
and
CDR3 is chosen from the group consisting of:
g) the amino acid sequences of SEQ ID NO's: 435-441;
h) amino acid sequences that have at least 80% amino acid identity with at least one of the amino acid sequences of SEQ ID NO's: 435-441;
i) amino acid sequences that have 3, 2, or 1 amino acid difference with at least one of the amino acid sequences of SEQ ID NO's: 435-441;
or any suitable fragment of such an amino acid sequences.

As generally mentioned herein for the amino acid sequences of the invention, when a Nanobody of the invention contains one or more CDR1 sequences according to b) and/or c):
i) any amino acid substitution in such a CDR according to b) and/or c) is preferably, and compared to the corresponding CDR according to a), a conservative amino acid substitution (as defined herein);
and/or
ii) the CDR according to b) and/or c) preferably only contains amino acid substitutions, and no amino acid deletions or insertions, compared to the corresponding CDR according to a);
and/or
iii) the CDR according to b) and/or c) may be a CDR that is derived from a CDR according to a) by means of affinity maturation using one or more techniques of affinity maturation known per se.

Similarly, when a Nanobody of the invention contains one or more CDR2 sequences according to e) and/or f):
i) any amino acid substitution in such a CDR according to e) and/or f) is preferably, and compared to the corresponding CDR according to d), a conservative amino acid substitution (as defined herein);
and/or
ii) the CDR according to e) and/or f) preferably only contains amino acid substitutions, and no amino acid deletions or insertions, compared to the corresponding CDR according to d);
and/or
iii) the CDR according to e) and/or f) may be a CDR that is derived from a CDR according to d) by means of affinity maturation using one or more techniques of affinity maturation known per se.

Also, similarly, when a Nanobody of the invention contains one or more CDR3 sequences according to h) and/or i):
i) any amino acid substitution in such a CDR according to h) and/or i) is preferably, and compared to the corresponding CDR according to g), a conservative amino acid substitution (as defined herein);
and/or
ii) the CDR according to h) and/or i) preferably only contains amino acid substitutions, and no amino acid deletions or insertions, compared to the corresponding CDR according to g);
and/or
iii) the CDR according to h) and/or i) may be a CDR that is derived from a CDR according to g) by means of affinity maturation using one or more techniques of affinity maturation known per se.

It should be understood that the last three paragraphs generally apply to any Nanobody of the invention that comprises one or more CDR1 sequences, CDR2 sequences and/or CDR3 sequences according to b), c), e), f), h) or i), respectively.

Of the Nanobodies of the invention, Nanobodies comprising one or more of the CDR's explicitly listed above are particularly preferred; Nanobodies comprising two or more of the CDR's explicitly listed above are more particularly preferred; and Nanobodies comprising three of the CDR's explicitly listed above are most particularly preferred.

Some particularly preferred, but non-limiting combinations of CDR sequences, as well as preferred combinations of CDR sequences and framework sequences, are mentioned in Table A-1d below, which lists the CDR sequences and framework sequences that are present in a number of preferred (but non-limiting) Nanobodies of the invention. As will be clear to the skilled person, a combination of CDR1, CDR2 and CDR3 sequences that occur in the same clone (i.e. CDR1, CDR2 and CDR3 sequences that are mentioned on the same line in Table A-1d) will usually be preferred (although the invention in its broadest sense is not limited thereto, and also comprises other suitable combinations of the CDR sequences mentioned in Table A-1d). Also, a combination of CDR sequences and framework sequences that occur in the same clone (i.e. CDR sequences and framework sequences that are mentioned on the same line in Table A-1d) will usually be preferred (although the invention in its broadest sense is not limited thereto, and also comprises other suitable combinations of the CDR sequences and framework sequences mentioned in Table A-1d, as well as combinations of such CDR sequences and other suitable framework sequences, e.g. as further described herein).

Also, in the Nanobodies of the invention that comprise the combinations of CDR's mentioned in Table A-1d, each CDR can be replaced by a CDR chosen from the group consisting of amino acid sequences that have at least 80%, preferably at least 90%, more preferably at least 95%, even more preferably at least 99% sequence identity (as defined herein) with the mentioned CDR's; in which:
i) any amino acid substitution in such a CDR is preferably, and compared to the corresponding CDR sequence mentioned in Table A-1d, a conservative amino acid substitution (as defined herein);
and/or
ii) any such CDR sequence preferably only contains amino acid substitutions, and no amino acid deletions or insertions, compared to the corresponding CDR sequence mentioned in Table A-1d;
and/or
iii) any such CDR sequence is a CDR that is derived by means of a technique for affinity maturation known per se, and in particular starting from the corresponding CDR sequence mentioned in Table A-1d.

However, as will be clear to the skilled person, the (combinations of) CDR sequences, as well as (the combinations of) CDR sequences and framework sequences mentioned in Table A-1d will generally be preferred.

TABLE A-1d

Preferred combinations of CDR sequences, preferred combinations of framework sequences, and preferred combinations of framework and CDR sequences for Nanobodies against PD-L2. ("ID" refers to the SEQ ID NO in the attached sequence listing)

| Clone | ID | FR1 | ID | CDR 1 | ID | FR2 | ID | CDR 2 | ID | FR3 | ID | CDR 3 | ID | FR4 |
|---|---|---|---|---|---|---|---|---|---|---|---|---|---|---|
| 103A9 | 400 | EVQLVESGGGL VQAGGSLRLSC AASESTVL | 407 | INAMG | 414 | WYRQAPG KQRELVA | 421 | SISSGGSTNY ADSVKG | 428 | RFTISRDNAKNIVYLQ MNSLKPEDTAVYYCNA | 435 | DVYPQDY GLGYVEG KVYYGMDY | 442 | WGTGTLVTVSS |
| 103E2 | 401 | EVQLVESGGGL VQAGGSLRLSC AASGSTFS | 408 | NYVSNY AMG | 415 | WGRQAPG TQRELVA | 422 | SISNGDTTNY ADSVKG | 429 | RFTISRDNAKNTVYLQ MNSLKPEDTAVYYCFE | 436 | HQVAGLT | 443 | WGQGTQVTVSS |
| 103G12 | 402 | EVQLVESGGGL VQAGGSLRLSC VASGXALK | 409 | IXVMG | 416 | WYRQAPG KQRELVA | 423 | AITSGGRTNY SDSVKG | 430 | RFTISGDNAXNTVYLQ MNSLKSEDTAVYYCRE | 437 | WNSGYPP VDY | 444 | WGQGTQVTVSS |
| 103F10 | 403 | EVQLVESGGGL VQAGGSLRLSC AASGRTFS | 410 | SGTMG | 417 | WFRRAPG KEREFVA | 424 | SIPWSGGRT YYADSVKD | 431 | RFTISRDNAQNTVFLQ MNSLKPEDTAVYYCAF | 438 | KERSTGW DFAS | 445 | WGQGIQVTVSS |
| 103E3 | 404 | EVQLVESGGGL VQTGGSLRLSC AASGFTLD | 411 | YYGIG | 418 | WFRQAPG KEREGVS | 425 | FISGSDGSTY YAESVKG | 432 | RFTISRDKAKNTVYLQ MNSLKPEDTAVYYCAA | 439 | DPWGPPSI ATMTSYEY KH | 446 | WGQGTQVTVSS |
| 103F6 | 405 | EVQLVESGGGL VQPGGSLRLSC AASGFTFS | 412 | TYTMI | 419 | WLRRAPG KGFEWVS | 426 | TIDKDGNTNY VDSVKG | 433 | RFAVSRDNTKNTLYLQ MNSLKPEDTAMYYCTK | 440 | HGSSA | 447 | RGQGTRVTVSS |
| 103D3 | 406 | EVQLVESGGGL VEPGGSLRLSC VASGFTFS | 413 | SYDMS | 420 | WVRQAPG KGLEWVS | 427 | TINSGGGITY RGSVKG | 434 | RFTISRDNAKNTLYLQ MNSLKPEDTAVYYCEN | 441 | GGSSYR | 448 | RGQGTQVTVSS |

Thus, in the Nanobodies of the invention, at least one of the CDR1, CDR2 and CDR3 sequences present is suitably chosen from the group consisting of the CDR1, CDR2 and CDR3 sequences, respectively, listed in Table A-1d; or from the group of CDR1, CDR2 and CDR3 sequences, respectively, that have at least 80%, preferably at least 90%, more preferably at least 95%, even more preferably at least 99% "sequence identity" (as defined herein) with at least one of the CDR1, CDR2 and CDR3 sequences, respectively, listed in Table A-1d; and/or from the group consisting of the CDR1, CDR2 and CDR3 sequences, respectively, that have 3, 2 or only 1 "amino acid difference(s)" (as defined herein) with at least one of the CDR1, CDR2 and CDR3 sequences, respectively, listed in Table A-1d.

In this context, by "suitably chosen" is meant that, as applicable, a CDR1 sequence is chosen from suitable CDR1 sequences (i.e. as defined herein), a CDR2 sequence is chosen from suitable CDR2 sequences (i.e. as defined herein), and a CDR3 sequence is chosen from suitable CDR3 sequence (i.e. as defined herein), respectively. More in particular, the CDR sequences are preferably chosen such that the Nanobodies of the invention bind to PD-L2 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In particular, in the Nanobodies of the invention, at least the CDR3 sequence present is suitably chosen from the group consisting of the CDR3 sequences listed in Table A-1d or from the group of CDR3 sequences that have at least 80%, preferably at least 90%, more preferably at least 95%, even more preferably at least 99% sequence identity with at least one of the CDR3 sequences listed in Table A-1d; and/or from the group consisting of the CDR3 sequences that have 3, 2 or only 1 amino acid difference(s) with at least one of the CDR3 sequences listed in Table A-1d.

Preferably, in the Nanobodies of the invention, at least two of the CDR1, CDR2 and CDR3 sequences present are suitably chosen from the group consisting of the CDR1, CDR2 and CDR3 sequences, respectively, listed in Table A-1d or from the group consisting of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table A-1d; and/or from the group consisting of the CDR1, CDR2 and CDR3 sequences, respectively, that have 3, 2 or only 1 "amino acid difference(s)" with at least one of the CDR1, CDR2 and CDR3 sequences, respectively, listed in Table A-1d.

In particular, in the Nanobodies of the invention, at least the CDR3 sequence present is suitably chosen from the group consisting of the CDR3 sequences listed in Table A-1d or from the group of CDR3 sequences that have at least 80%, preferably at least 90%, more preferably at least 95%, even more preferably at least 99% sequence identity with at least one of the CDR3 sequences listed in Table A-1d, respectively; and at least one of the CDR1 and CDR2 sequences present is suitably chosen from the group consisting of the CDR1 and CDR2 sequences, respectively, listed in Table A-1d or from the group of CDR1 and CDR2 sequences, respectively, that have at least 80%, preferably at least 90%, more preferably at least 95%, even more preferably at least 99% sequence identity with at least one of the CDR1 and CDR2 sequences, respectively, listed in Table A-1d; and/or from the group consisting of the CDR1 and CDR2 sequences, respectively, that have 3, 2 or only 1 amino acid difference(s) with at least one of the CDR1 and CDR2 sequences, respectively, listed in Table A-1d.

Most preferably, in the Nanobodies of the invention, all three CDR1, CDR2 and CDR3 sequences present are suitably chosen from the group consisting of the CDR1, CDR2 and CDR3 sequences, respectively, listed in Table A-1d or from the group of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table A-1d; and/or from the group consisting of the CDR1, CDR2 and CDR3 sequences, respectively, that have 3, 2 or only 1 amino acid difference(s) with at least one of the CDR1, CDR2 and CDR3 sequences, respectively, listed in Table A-1d.

Even more preferably, in the Nanobodies of the invention, at least one of the CDR1, CDR2 and CDR3 sequences present is suitably chosen from the group consisting of the CDR1, CDR2 and CDR3 sequences, respectively, listed in Table A-1d. Preferably, in this aspect, at least one or preferably both of the other two CDR sequences present are suitably chosen from CDR sequences that have at least 80%, preferably at least 90%, more preferably at least 95%, even more preferably at least 99% sequence identity with at least one of the corresponding CDR sequences, respectively, listed in Table A-1d; and/or from the group consisting of the CDR sequences that have 3, 2 or only 1 amino acid difference(s) with at least one of the corresponding sequences, respectively, listed in Table A-1d.

In particular, in the Nanobodies of the invention, at least the CDR3 sequence present is suitably chosen from the group consisting of the CDR3 listed in Table A-1d. Preferably, in this aspect, at least one and preferably both of the CDR1 and CDR2 sequences present are suitably chosen from the groups of CDR1 and CDR2 sequences, respectively, that have at least 80%, preferably at least 90%, more preferably at least 95%, even more preferably at least 99% sequence identity with the CDR1 and CDR2 sequences, respectively, listed in Table A-1d; and/or from the group consisting of the CDR1 and CDR2 sequences, respectively, that have 3, 2 or only 1 amino acid difference(s) with at least one of the CDR1 and CDR2 sequences, respectively, listed in Table A-1d.

Even more preferably, in the Nanobodies of the invention, at least two of the CDR1, CDR2 and CDR3 sequences present are suitably chosen from the group consisting of the CDR1, CDR2 and CDR3 sequences, respectively, listed in Table A-1d. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table A-1d; and/or from the group consisting of CDR sequences that have 3, 2 or only 1 amino acid difference(s) with at least one of the corresponding sequences listed in Table A-1d.

In particular, in the Nanobodies of the invention, at least the CDR3 sequence is suitably chosen from the group consisting of the CDR3 sequences listed in Table A-1d, and either the CDR1 sequence or the CDR2 sequence is suitably chosen from the group consisting of the CDR1 and CDR2 sequences, respectively, listed in Table A-1d. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table A-1d; and/or from the group consisting of CDR sequences that have 3, 2 or only 1 amino acid difference(s) with the corresponding CDR sequences listed in Table A-1d.

Even more preferably, in the Nanobodies of the invention, all three CDR1, CDR2 and CDR3 sequences present are suitably chosen from the group consisting of the CDR1, CDR2 and CDR3 sequences, respectively, listed in Table A-1d.

Also, generally, the combinations of CDR's listed in Table A-1d (i.e. those mentioned on the same line in Table A-1d) are preferred. Thus, it is generally preferred that, when a CDR in a Nanobody of the invention is a CDR sequence mentioned in Table A-1d or is suitably chosen from the group of CDR sequences that have at least 80%, preferably at least 90%, more preferably at least 95%, even more preferably at least 99% sequence identity with a CDR sequence listed in Table A-1d; and/or from the group consisting of CDR sequences that have 3, 2 or only 1 amino acid difference(s) with a CDR sequence listed in Table A-1d, that at least one and preferably both of the other CDR's are suitably chosen from the CDR sequences that belong to the same combination in Table A-1d (i.e. mentioned on the same line in Table A-1d) or are suitably chosen from the group of CDR sequences that have at least 80%, preferably at least 90%, more preferably at least 95%, even more preferably at least 99% sequence identity with the CDR sequence(s) belonging to the same combination and/or from the group consisting of CDR sequences that have 3, 2 or only 1 amino acid difference(s) with the CDR sequence(s) belonging to the same combination. The other preferences indicated in the above paragraphs also apply to the combinations of CDR's mentioned in Table A-1s.

Thus, by means of non-limiting examples, a Nanobody of the invention can for example comprise a CDR1 sequence that has more than 80% sequence identity with one of the CDR1 sequences mentioned in Table A-1s, a CDR2 sequence that has 3, 2 or 1 amino acid difference with one of the CDR2 sequences mentioned in Table A-1s (but belonging to a different combination), and a CDR3 sequence.

Some preferred Nanobodies of the invention may for example comprise: (1) a CDR1 sequence that has more than 80% sequence identity with one of the CDR1 sequences mentioned in Table A-1d; a CDR2 sequence that has 3, 2 or 1 amino acid difference with one of the CDR2 sequences mentioned in Table A-1d (but belonging to a different combination); and a CDR3 sequence that has more than 80% sequence identity with one of the CDR3 sequences mentioned in Table A-1d (but belonging to a different combination); or (2) a CDR1 sequence that has more than 80% sequence identity with one of the CDR1 sequences mentioned in Table A-1d; a CDR2 sequence, and one of the CDR3 sequences listed in Table A-1d; or (3) a CDR1 sequence; a CDR2 sequence that has more than 80% sequence identity with one of the CDR2 sequence listed in Table A-1d; and a CDR3 sequence that has 3, 2 or 1 amino acid differences with the CDR3 sequence mentioned in Table A-1d that belongs to the same combination as the CDR2 sequence.

Some particularly preferred Nanobodies of the invention may for example comprise: (1) a CDR1 sequence that has more than 80% sequence identity with one of the CDR1 sequences mentioned in Table A-1d; a CDR2 sequence that has 3, 2 or 1 amino acid difference with the CDR2 sequence mentioned in Table A-1d that belongs to the same combination; and a CDR3 sequence that has more than 80% sequence identity with the CDR3 sequence mentioned in Table A-1d that belongs to the same combination; (2) a CDR1 sequence; a CDR 2 listed in Table A-1d and a CDR3 sequence listed in Table A-1d (in which the CDR2 sequence and CDR3 sequence may belong to different combinations).

Some even more preferred Nanobodies of the invention may for example comprise: (1) a CDR1 sequence that has more than 80% sequence identity with one of the CDR1 sequences mentioned in Table A-1d; the CDR2 sequence listed in Table A-1d that belongs to the same combination; and a CDR3 sequence mentioned in Table A-1d that belongs to a different combination; or (2) a CDR1 sequence mentioned in Table A-1d; a CDR2 sequence that has 3, 2 or 1 amino acid differences with the CDR2 sequence mentioned in Table A-1d that belongs to the same combination; and a CDR3 sequence that has more than 80% sequence identity with the CDR3 sequence listed in Table A-1d that belongs to the same or a different combination.

Particularly preferred Nanobodies of the invention may for example comprise a CDR1 sequence mentioned in Table A-1d, a CDR2 sequence that has more than 80% sequence identity with the CDR2 sequence mentioned in Table A-1d that belongs to the same combination; and the CDR3 sequence mentioned in Table A-1d that belongs to the same combination.

In the most preferred Nanobodies of the invention, the CDR1, CDR2 and CDR3 sequences present are suitably chosen from one of the combinations of CDR1, CDR2 and CDR3 sequences, respectively, listed in Table A-1d.

According to another preferred, but non-limiting aspect of the invention (a) CDR1 has a length of between 1 and 12 amino acid residues, and usually between 2 and 9 amino acid residues, such as 5, 6 or 7 amino acid residues; and/or (b) CDR2 has a length of between 13 and 24 amino acid residues, and usually between 15 and 21 amino acid residues, such as 16 and 17 amino acid residues; and/or (c) CDR3 has a length of between 2 and 35 amino acid residues, and usually between 3 and 30 amino acid residues, such as between 6 and 23 amino acid residues.

In another preferred, but non-limiting aspect, the invention relates to a Nanobody in which the CDR sequences (as defined herein) have more than 80%, preferably more than 90%, more preferably more than 95%, such as 99% or more sequence identity (as defined herein) with the CDR sequences of at least one of the amino acid sequences of SEQ ID NO's: 449-455.

Generally, Nanobodies with the above CDR sequences may be as further described herein, and preferably have framework sequences that are also as further described herein. Thus, for example and as mentioned herein, such Nanobodies may be naturally occurring Nanobodies (from any suitable species), naturally occurring $V_{HH}$ sequences (i.e. from a suitable species of Camelid) or synthetic or semi-synthetic amino acid sequences or Nanobodies, including but not limited to partially humanized Nanobodies or $V_{HH}$ sequences, fully humanized Nanobodies or $V_{HH}$ sequences, camelized heavy chain variable domain sequences, as well as Nanobodies that have been obtained by the techniques mentioned herein.

Thus, in one specific, but non-limiting aspect, the invention relates to a humanized Nanobody, which consists of 4 framework regions (FR1 to FR4 respectively) and 3 complementarity determining regions (CDR1 to CDR3 respectively), in which CDR1 to CDR3 are as defined herein and in which said humanized Nanobody comprises at least one humanizing substitution (as defined herein), and in particular at least one humanizing substitution in at least one of its framework sequences (as defined herein).

In another preferred, but non-limiting aspect, the invention relates to a Nanobody in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 449-455. This degree of amino acid identity can for example be determined by determining the degree of amino acid identity (in a manner described herein) between said Nanobody and one or more of the sequences of SEQ ID NO's: 449-455, in which the amino acid residues that form the framework regions are disregarded. Such Nanobodies can be as further described herein.

In another preferred, but non-limiting aspect, the invention relates to a Nanobody with an amino acid sequence that is chosen from the group consisting of SEQ ID NO's: 449-455 or from the group consisting of from amino acid sequences that have more than 80%, preferably more than 90%, more preferably more than 95%, such as 99% or more sequence identity (as defined herein) with at least one of the amino acid sequences of SEQ ID NO's: 449-455.

Another preferred, but non-limiting aspect of the invention relates to humanized variants of the Nanobodies of SEQ ID NO's: 449-455, that comprise, compared to the corresponding native $V_{HH}$ sequence, at least one humanizing substitution (as defined herein), and in particular at least one humanizing substitution in at least one of its framework sequences (as defined herein).

In another preferred but non-limiting aspect, the invention relates to a Nanobody (as defined herein) against ICOSL, which consists of 4 framework regions (FR1 to FR4 respectively) and 3 complementarity determining regions (CDR1 to CDR3 respectively), in which:

CDR1 is chosen from the group consisting of:
a) the amino acid sequences of SEQ ID NO's: 463-469;
b) amino acid sequences that have at least 80% amino acid identity with at least one of the amino acid sequences of SEQ ID NO's: 463-469;
c) amino acid sequences that have 3, 2, or 1 amino acid difference with at least one of the amino acid sequences of SEQ ID NO's: 463-469;

and/or

CDR2 is chosen from the group consisting of:
d) the amino acid sequences of SEQ ID NO's: 477-483;
e) amino acid sequences that have at least 80% amino acid identity with at least one of the amino acid sequences of SEQ ID NO's: 477-483;
f) amino acid sequences that have 3, 2, or 1 amino acid difference with at least one of the amino acid sequences of SEQ ID NO's: 477-483;

and/or

CDR3 is chosen from the group consisting of:
g) the amino acid sequences of SEQ ID NO's: 491-497;
h) amino acid sequences that have at least 80% amino acid identity with at least one of the amino acid sequences of SEQ ID NO's: 491-497;
i) amino acid sequences that have 3, 2, or 1 amino acid difference with at least one of the amino acid sequences of SEQ ID NO's: 491-497;

or any suitable fragment of such an amino acid sequence.

In particular, according to this preferred but non-limiting aspect, the invention relates to a Nanobody (as defined herein) against ICOSL, which consists of 4 framework regions (FR1 to FR4 respectively) and 3 complementarity determining regions (CDR1 to CDR3 respectively), in which:

CDR1 is chosen from the group consisting of:
a) the amino acid sequences of SEQ ID NO's: 463-469;
b) amino acid sequences that have at least 80% amino acid identity with at least one of the amino acid sequences of SEQ ID NO's: 463-469;

c) amino acid sequences that have 3, 2, or 1 amino acid difference with at least one of the amino acid sequences of SEQ ID NO's: 463-469;
and
CDR2 is chosen from the group consisting of:
d) the amino acid sequences of SEQ ID NO's: 477-483;
e) amino acid sequences that have at least 80% amino acid identity with at least one of the amino acid sequences of SEQ ID NO's: 477-483;
f) amino acid sequences that have 3, 2, or 1 amino acid difference with at least one of the amino acid sequences of SEQ ID NO's: 477-483;
and
CDR3 is chosen from the group consisting of:
g) the amino acid sequences of SEQ ID NO's: 491-497;
h) amino acid sequences that have at least 80% amino acid identity with at least one of the amino acid sequences of SEQ ID NO's: 491-497;
i) amino acid sequences that have 3, 2, or 1 amino acid difference with at least one of the amino acid sequences of SEQ ID NO's: 491-497;
or any suitable fragment of such an amino acid sequences.

As generally mentioned herein for the amino acid sequences of the invention, when a Nanobody of the invention contains one or more CDR1 sequences according to b) and/or c):
i) any amino acid substitution in such a CDR according to b) and/or c) is preferably, and compared to the corresponding CDR according to a), a conservative amino acid substitution (as defined herein);
and/or
ii) the CDR according to b) and/or c) preferably only contains amino acid substitutions, and no amino acid deletions or insertions, compared to the corresponding CDR according to a);
and/or
iii) the CDR according to b) and/or c) may be a CDR that is derived from a CDR according to a) by means of affinity maturation using one or more techniques of affinity maturation known per se.

Similarly, when a Nanobody of the invention contains one or more CDR2 sequences according to e) and/or f):
i) any amino acid substitution in such a CDR according to e) and/or f) is preferably, and compared to the corresponding CDR according to d), a conservative amino acid substitution (as defined herein);
and/or
ii) the CDR according to e) and/or f) preferably only contains amino acid substitutions, and no amino acid deletions or insertions, compared to the corresponding CDR according to d);
and/or
iii) the CDR according to e) and/or f) may be a CDR that is derived from a CDR according to d) by means of affinity maturation using one or more techniques of affinity maturation known per se.

Also, similarly, when a Nanobody of the invention contains one or more CDR3 sequences according to h) and/or i):
i) any amino acid substitution in such a CDR according to h) and/or i) is preferably, and compared to the corresponding CDR according to g), a conservative amino acid substitution (as defined herein);
and/or
ii) the CDR according to h) and/or i) preferably only contains amino acid substitutions, and no amino acid deletions or insertions, compared to the corresponding CDR according to g);
and/or
iii) the CDR according to h) and/or i) may be a CDR that is derived from a CDR according to g) by means of affinity maturation using one or more techniques of affinity maturation known per se.

It should be understood that the last three paragraphs generally apply to any Nanobody of the invention that comprises one or more CDR1 sequences, CDR2 sequences and/or CDR3 sequences according to b), c), e), f), h) or i), respectively.

Of the Nanobodies of the invention, Nanobodies comprising one or more of the CDR's explicitly listed above are particularly preferred; Nanobodies comprising two or more of the CDR's explicitly listed above are more particularly preferred; and Nanobodies comprising three of the CDR's explicitly listed above are most particularly preferred.

Some particularly preferred, but non-limiting combinations of CDR sequences, as well as preferred combinations of CDR sequences and framework sequences, are mentioned in Table A-1e below, which lists the CDR sequences and framework sequences that are present in a number of preferred (but non-limiting) Nanobodies of the invention. As will be clear to the skilled person, a combination of CDR1, CDR2 and CDR3 sequences that occur in the same clone (i.e. CDR1, CDR2 and CDR3 sequences that are mentioned on the same line in Table A-1e) will usually be preferred (although the invention in its broadest sense is not limited thereto, and also comprises other suitable combinations of the CDR sequences mentioned in Table A-1e). Also, a combination of CDR sequences and framework sequences that occur in the same clone (i.e. CDR sequences and framework sequences that are mentioned on the same line in Table A-1e) will usually be preferred (although the invention in its broadest sense is not limited thereto, and also comprises other suitable combinations of the CDR sequences and framework sequences mentioned in Table A-1e, as well as combinations of such CDR sequences and other suitable framework sequences, e.g. as further described herein).

Also, in the Nanobodies of the invention that comprise the combinations of CDR's mentioned in Table A-1e, each CDR can be replaced by a CDR chosen from the group consisting of amino acid sequences that have at least 80%, preferably at least 90%, more preferably at least 95%, even more preferably at least 99% sequence identity (as defined herein) with the mentioned CDR's; in which:
i) any amino acid substitution in such a CDR is preferably, and compared to the corresponding CDR sequence mentioned in Table A-1e, a conservative amino acid substitution (as defined herein);
and/or
ii) any such CDR sequence preferably only contains amino acid substitutions, and no amino acid deletions or insertions, compared to the corresponding CDR sequence mentioned in Table A-1e;
and/or
iii) any such CDR sequence is a CDR that is derived by means of a technique for affinity maturation known per se, and in particular starting from the corresponding CDR sequence mentioned in Table A-1e.

However, as will be clear to the skilled person, the (combinations of) CDR sequences, as well as (the combinations of) CDR sequences and framework sequences mentioned in Table A-1e will generally be preferred.

TABLE A-1e

Preferred combinations of CDR sequences, preferred combinations of framework sequences, and preferred combinations of framework and CDR sequences for Nanobodies against ICOSL. ("ID" refers to the SEQ ID NO in the attached sequence listing)

| Clone | ID FR1 | ID CDR 1 | ID FR2 | ID CDR 2 | ID FR3 | ID CDR 3 | ID FR4 |
|---|---|---|---|---|---|---|---|
| 95A6 | 456 EVQLVESGGGLVQAGGSLRLSCALSGRAVS | 463 IAATAMG | 470 WYRQAPGKQRELVA | 477 ARWSGGSIQYLDSVKG | 484 RFTISRDNAKNTVYLQMNSLTPEDTAVYYCNT | 491 LPWRANY | 498 SGQGTQVTVSS |
| 95B11 | 457 EVQLVESGGGLVQPGGSLRLSCAASRSISS | 464 FNLLG | 471 WYRQAPGKQRELVA | 478 HLLSGGSTVYPDSVKG | 485 RFTVSRDNTKNTVYLQMNSLKPEDTAVYYCNA | 492 IAPALGSS | 499 WGQGTQVTVSS |
| 95F8 | 458 EVQLVESGGGLVQAGGSLRLSCAASGIAFS | 465 IDIMD | 472 WYRQAPGKERELVA | 479 TISGGGSTNYADSVKG | 486 RFIVSRDNAKNILYLQMNSLKPDDTAVYYCNA | 493 RRLIYGRTVY | 500 WGQGTQVTVSS |
| 95H8 | 459 EVQLVESGGGLVQTGGSLRLSCAASSSTST | 466 SSIDVMG | 473 WYRQSPGKQRELVA | 480 SISSFGSTYYADSVKG | 487 RFIISRDNAKNTVNLQMNNLKLEDTAVHFCNL | 494 RRLSPPPLLDY | 501 WGQGTQVTVSS |
| 95G5 | 460 EVQLVESGGGLVQAGGSLRLSCASSGSTFS | 467 IDVMG | 474 WYRQAPGKVRERVA | 481 IIGTGGFPVYADSVKG | 488 RFTISRDNAKNTVYLQMNSLKPEDTAVYYCNA | 495 ARLVALGS | 502 WGQGTQVTVSS |
| 95E6 | 461 EVQLVESGGALVQPGGSLRLSCAASGFTLG | 468 DYVIG | 475 WFRQAPGKEREWVS | 482 GISSRDDTTYYANSVKG | 489 RFTISRDNAKNTMYLQMNSLKPEDSAVYYCAL | 496 RSGIAVARAPTNYDY | 503 WGQGTQVTVSS |
| 95G6 | 462 EVQLVESGGALVQPGGSLRLSCAASGFTLG | 469 DYVIG | 476 WFRQAPGKEREWVS | 483 GISSRDGTTYYADSVKG | 490 RFTISRDNAKNTMYLQMNSLKPEDTAVYYCAL | 497 RSGIAVARAPSNYDY | 504 WGQGTQVTVSS |

Thus, in the Nanobodies of the invention, at least one of the CDR1, CDR2 and CDR3 sequences present is suitably chosen from the group consisting of the CDR1, CDR2 and CDR3 sequences, respectively, listed in Table A-1e; or from the group of CDR1, CDR2 and CDR3 sequences, respectively, that have at least 80%, preferably at least 90%, more preferably at least 95%, even more preferably at least 99% "sequence identity" (as defined herein) with at least one of the CDR1, CDR2 and CDR3 sequences, respectively, listed in Table A-1e; and/or from the group consisting of the CDR1, CDR2 and CDR3 sequences, respectively, that have 3, 2 or only 1 "amino acid difference(s)" (as defined herein) with at least one of the CDR1, CDR2 and CDR3 sequences, respectively, listed in Table A-1e.

In this context, by "suitably chosen" is meant that, as applicable, a CDR1 sequence is chosen from suitable CDR1 sequences (i.e. as defined herein), a CDR2 sequence is chosen from suitable CDR2 sequences (i.e. as defined herein), and a CDR3 sequence is chosen from suitable CDR3 sequence (i.e. as defined herein), respectively. More in particular, the CDR sequences are preferably chosen such that the Nanobodies of the invention bind to ICOSL with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In particular, in the Nanobodies of the invention, at least the CDR3 sequence present is suitably chosen from the group consisting of the CDR3 sequences listed in Table A-1e or from the group of CDR3 sequences that have at least 80%, preferably at least 90%, more preferably at least 95%, even more preferably at least 99% sequence identity with at least one of the CDR3 sequences listed in Table A-1e; and/or from the group consisting of the CDR3 sequences that have 3, 2 or only 1 amino acid difference(s) with at least one of the CDR3 sequences listed in Table A-1e.

Preferably, in the Nanobodies of the invention, at least two of the CDR1, CDR2 and CDR3 sequences present are suitably chosen from the group consisting of the CDR1, CDR2 and CDR3 sequences, respectively, listed in Table A-1e or from the group consisting of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table A-1e; and/or from the group consisting of the CDR1, CDR2 and CDR3 sequences, respectively, that have 3, 2 or only 1 "amino acid difference(s)" with at least one of the CDR1, CDR2 and CDR3 sequences, respectively, listed in Table A-1e.

In particular, in the Nanobodies of the invention, at least the CDR3 sequence present is suitably chosen from the group consisting of the CDR3 sequences listed in Table A-1e or from the group of CDR3 sequences that have at least 80%, preferably at least 90%, more preferably at least 95%, even more preferably at least 99% sequence identity with at least one of the CDR3 sequences listed in Table A-1e, respectively; and at least one of the CDR1 and CDR2 sequences present is suitably chosen from the group consisting of the CDR1 and CDR2 sequences, respectively, listed in Table A-1e or from the group of CDR1 and CDR2 sequences, respectively, that have at least 80%, preferably at least 90%, more preferably at least 95%, even more preferably at least 99% sequence identity with at least one of the CDR1 and CDR2 sequences, respectively, listed in Table A-1e; and/or from the group consisting of the CDR1 and CDR2 sequences, respectively, that have 3, 2 or only 1 amino acid difference(s) with at least one of the CDR1 and CDR2 sequences, respectively, listed in Table A-1e.

Most preferably, in the Nanobodies of the invention, all three CDR1, CDR2 and CDR3 sequences present are suitably chosen from the group consisting of the CDR1, CDR2 and CDR3 sequences, respectively, listed in Table A-1e or from the group of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table A-1e; and/or from the group consisting of the CDR1, CDR2 and CDR3 sequences, respectively, that have 3, 2 or only 1 amino acid difference(s) with at least one of the CDR1, CDR2 and CDR3 sequences, respectively, listed in Table A-1e.

Even more preferably, in the Nanobodies of the invention, at least one of the CDR1, CDR2 and CDR3 sequences present is suitably chosen from the group consisting of the CDR1, CDR2 and CDR3 sequences, respectively, listed in Table A-1e. Preferably, in this aspect, at least one or preferably both of the other two CDR sequences present are suitably chosen from CDR sequences that have at least 80%, preferably at least 90%, more preferably at least 95%, even more preferably at least 99% sequence identity with at least one of the corresponding CDR sequences, respectively, listed in Table A-1e; and/or from the group consisting of the CDR sequences that have 3, 2 or only 1 amino acid difference(s) with at least one of the corresponding sequences, respectively, listed in Table A-1e.

In particular, in the Nanobodies of the invention, at least the CDR3 sequence present is suitably chosen from the group consisting of the CDR3 listed in Table A-1e. Preferably, in this aspect, at least one and preferably both of the CDR1 and CDR2 sequences present are suitably chosen from the groups of CDR1 and CDR2 sequences, respectively, that have at least 80%, preferably at least 90%, more preferably at least 95%, even more preferably at least 99% sequence identity with the CDR1 and CDR2 sequences, respectively, listed in Table A-1e; and/or from the group consisting of the CDR1 and CDR2 sequences, respectively, that have 3, 2 or only 1 amino acid difference(s) with at least one of the CDR1 and CDR2 sequences, respectively, listed in Table A-1e.

Even more preferably, in the Nanobodies of the invention, at least two of the CDR1, CDR2 and CDR3 sequences present are suitably chosen from the group consisting of the CDR1, CDR2 and CDR3 sequences, respectively, listed in Table A-1e. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table A-1e; and/or from the group consisting of CDR sequences that have 3, 2 or only 1 amino acid difference(s) with at least one of the corresponding sequences listed in Table A-1e.

In particular, in the Nanobodies of the invention, at least the CDR3 sequence is suitably chosen from the group consisting of the CDR3 sequences listed in Table A-1e, and either the CDR1 sequence or the CDR2 sequence is suitably chosen from the group consisting of the CDR1 and CDR2 sequences, respectively, listed in Table A-1e. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table A-1e; and/or from the group consisting of CDR sequences that have 3, 2 or only 1 amino acid difference(s) with the corresponding CDR sequences listed in Table A-1e.

Even more preferably, in the Nanobodies of the invention, all three CDR1, CDR2 and CDR3 sequences present are suitably chosen from the group consisting of the CDR1, CDR2 and CDR3 sequences, respectively, listed in Table A-1e.

Also, generally, the combinations of CDR's listed in Table A-1e (i.e. those mentioned on the same line in Table A-1e) are preferred. Thus, it is generally preferred that, when a CDR in a Nanobody of the invention is a CDR sequence mentioned in Table A-1e or is suitably chosen from the group of CDR sequences that have at least 80%, preferably at least 90%, more preferably at least 95%, even more preferably at least 99% sequence identity with a CDR sequence listed in Table A-1e; and/or from the group consisting of CDR sequences that have 3, 2 or only 1 amino acid difference(s) with a CDR sequence listed in Table A-1e, that at least one and preferably both of the other CDR's are suitably chosen from the CDR sequences that belong to the same combination in Table A-1e (i.e. mentioned on the same line in Table A-1e) or are suitably chosen from the group of CDR sequences that have at least 80%, preferably at least 90%, more preferably at least 95%, even more preferably at least 99% sequence identity with the CDR sequence(s) belonging to the same combination and/or from the group consisting of CDR sequences that have 3, 2 or only 1 amino acid difference(s) with the CDR sequence(s) belonging to the same combination. The other preferences indicated in the above paragraphs also apply to the combinations of CDR's mentioned in Table A-1e.

Thus, by means of non-limiting examples, a Nanobody of the invention can for example comprise a CDR1 sequence that has more than 80% sequence identity with one of the CDR1 sequences mentioned in Table A-1e, a CDR2 sequence that has 3, 2 or 1 amino acid difference with one of the CDR2 sequences mentioned in Table A-1e (but belonging to a different combination), and a CDR3 sequence.

Some preferred Nanobodies of the invention may for example comprise: (1) a CDR1 sequence that has more than 80% sequence identity with one of the CDR1 sequences mentioned in Table A-1e; a CDR2 sequence that has 3, 2 or 1 amino acid difference with one of the CDR2 sequences mentioned in Table A-1e (but belonging to a different combination); and a CDR3 sequence that has more than 80% sequence identity with one of the CDR3 sequences mentioned in Table A-1e (but belonging to a different combination); or (2) a CDR1 sequence that has more than 80% sequence identity with one of the CDR1 sequences mentioned in Table A-1e; a CDR2 sequence, and one of the CDR3 sequences listed in Table A-1e; or (3) a CDR1 sequence; a CDR2 sequence that has more than 80% sequence identity with one of the CDR2 sequence listed in Table A-1e; and a CDR3 sequence that has 3, 2 or 1 amino acid differences with the CDR3 sequence mentioned in Table A-1e that belongs to the same combination as the CDR2 sequence.

Some particularly preferred Nanobodies of the invention may for example comprise: (1) a CDR1 sequence that has more than 80% sequence identity with one of the CDR1 sequences mentioned in Table A-1e; a CDR2 sequence that has 3, 2 or 1 amino acid difference with the CDR2 sequence mentioned in Table A-1e that belongs to the same combination; and a CDR3 sequence that has more than 80% sequence identity with the CDR3 sequence mentioned in Table A-1e that belongs to the same combination; (2) a CDR1 sequence; a CDR 2 listed in Table A-1e and a CDR3 sequence listed in Table A-1e (in which the CDR2 sequence and CDR3 sequence may belong to different combinations).

Some even more preferred Nanobodies of the invention may for example comprise: (1) a CDR1 sequence that has more than 80% sequence identity with one of the CDR1 sequences mentioned in Table A-1e; the CDR2 sequence listed in Table A-1e that belongs to the same combination; and a CDR3 sequence mentioned in Table A-1e that belongs to a different combination; or (2) a CDR1 sequence mentioned in Table A-1e; a CDR2 sequence that has 3, 2 or 1 amino acid differences with the CDR2 sequence mentioned in Table A-1e that belongs to the same combination; and a CDR3 sequence that has more than 80% sequence identity with the CDR3 sequence listed in Table A-1e that belongs to the same or a different combination.

Particularly preferred Nanobodies of the invention may for example comprise a CDR1 sequence mentioned in Table A-1e, a CDR2 sequence that has more than 80% sequence identity with the CDR2 sequence mentioned in Table A-1e that belongs to the same combination; and the CDR3 sequence mentioned in Table A-1e that belongs to the same combination.

In the most preferred Nanobodies of the invention, the CDR1, CDR2 and CDR3 sequences present are suitably chosen from one of the combinations of CDR1, CDR2 and CDR3 sequences, respectively, listed in Table A-1e.

According to another preferred, but non-limiting aspect of the invention (a) CDR1 has a length of between 1 and 12 amino acid residues, and usually between 2 and 9 amino acid residues, such as 5, 6 or 7 amino acid residues; and/or (b) CDR2 has a length of between 13 and 24 amino acid residues, and usually between 15 and 21 amino acid residues, such as 16 and 17 amino acid residues; and/or (c) CDR3 has a length of between 2 and 35 amino acid residues, and usually between 3 and 30 amino acid residues, such as between 6 and 23 amino acid residues.

In another preferred, but non-limiting aspect, the invention relates to a Nanobody in which the CDR sequences (as defined herein) have more than 80%, preferably more than 90%, more preferably more than 95%, such as 99% or more sequence identity (as defined herein) with the CDR sequences of at least one of the amino acid sequences of SEQ ID NO's: 505-511.

Generally, Nanobodies with the above CDR sequences may be as further described herein, and preferably have framework sequences that are also as further described herein. Thus, for example and as mentioned herein, such Nanobodies may be naturally occurring Nanobodies (from any suitable species), naturally occurring $V_{HH}$ sequences (i.e. from a suitable species of Camelid) or synthetic or semi-synthetic amino acid sequences or Nanobodies, including but not limited to partially humanized Nanobodies or $V_{HH}$ sequences, fully humanized Nanobodies or $V_{HH}$ sequences, camelized heavy chain variable domain sequences, as well as Nanobodies that have been obtained by the techniques mentioned herein.

Thus, in one specific, but non-limiting aspect, the invention relates to a humanized Nanobody, which consists of 4 framework regions (FR1 to FR4 respectively) and 3 complementarity determining regions (CDR1 to CDR3 respectively), in which CDR1 to CDR3 are as defined herein and in which said humanized Nanobody comprises at least one humanizing substitution (as defined herein), and in particular at least one humanizing substitution in at least one of its framework sequences (as defined herein).

In another preferred, but non-limiting aspect, the invention relates to a Nanobody in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 505-511. This degree of amino acid identity can for example be determined by determining the degree of amino acid identity (in a manner described herein) between said Nanobody and one or more of the sequences of SEQ ID NO's: 505-511, in which the amino acid residues that form the framework regions are disregarded. Such Nanobodies can be as further described herein.

In another preferred, but non-limiting aspect, the invention relates to a Nanobody with an amino acid sequence that is chosen from the group consisting of SEQ ID NO's: 505-511 or from the group consisting of from amino acid sequences that have more than 80%, preferably more than 90%, more preferably more than 95%, such as 99% or more sequence identity (as defined herein) with at least one of the amino acid sequences of SEQ ID NO's: 505-511.

Another preferred, but non-limiting aspect of the invention relates to humanized variants of the Nanobodies of SEQ ID NO's: 505-511, that comprise, compared to the corresponding native $V_{HH}$ sequence, at least one humanizing substitution (as defined herein), and in particular at least one humanizing substitution in at least one of its framework sequences (as defined herein).

In another preferred but non-limiting aspect, the invention relates to a Nanobody (as defined herein) against CD28, which consists of 4 framework regions (FR1 to FR4 respectively) and 3 complementarity determining regions (CDR1 to CDR3 respectively), in which:

CDR1 is chosen from the group consisting of:
the amino acid sequences of SEQ ID NO's: 518-523;
amino acid sequences that have at least 80% amino acid identity with at least one of the amino acid sequences of SEQ ID NO's: 518-523;
amino acid sequences that have 3, 2, or 1 amino acid difference with at least one of the amino acid sequences of SEQ ID NO's: 518-523;
and/or
CDR2 is chosen from the group consisting of:
the amino acid sequences of SEQ ID NO's: 530-535;
amino acid sequences that have at least 80% amino acid identity with at least one of the amino acid sequences of SEQ ID NO's: 530-535;
amino acid sequences that have 3, 2, or 1 amino acid difference with at least one of the amino acid sequences of SEQ ID NO's: 530-535;
and/or
CDR3 is chosen from the group consisting of:
the amino acid sequences of SEQ ID NO's: 542-547;
amino acid sequences that have at least 80% amino acid identity with at least one of the amino acid sequences of SEQ ID NO's: 542-547;
amino acid sequences that have 3, 2, or 1 amino acid difference with at least one of the amino acid sequences of SEQ ID NO's: 542-547;
or any suitable fragment of such an amino acid sequence.

In particular, according to this preferred but non-limiting aspect, the invention relates to a Nanobody (as defined herein) against CD28, which consists of 4 framework regions (FR1 to FR4 respectively) and 3 complementarity determining regions (CDR1 to CDR3 respectively), in which:

CDR1 is chosen from the group consisting of:
the amino acid sequences of SEQ ID NO's: 518-523;
amino acid sequences that have at least 80% amino acid identity with at least one of the amino acid sequences of SEQ ID NO's: 518-523;

amino acid sequences that have 3, 2, or 1 amino acid difference with at least one of the amino acid sequences of SEQ ID NO's: 518-523;
and
CDR2 is chosen from the group consisting of:
the amino acid sequences of SEQ ID NO's: 530-535;
amino acid sequences that have at least 80% amino acid identity with at least one of the amino acid sequences of SEQ ID NO's: 530-535;
amino acid sequences that have 3, 2, or 1 amino acid difference with at least one of the amino acid sequences of SEQ ID NO's: 530-535;
and
CDR3 is chosen from the group consisting of:
the amino acid sequences of SEQ ID NO's: 542-547;
amino acid sequences that have at least 80% amino acid identity with at least one of the amino acid sequences of SEQ ID NO's: 542-547;
amino acid sequences that have 3, 2, or 1 amino acid difference with at least one of the amino acid sequences of SEQ ID NO's: 542-547;
or any suitable fragment of such an amino acid sequences.

As generally mentioned herein for the amino acid sequences of the invention, when a Nanobody of the invention contains one or more CDR1 sequences according to b) and/or c):
any amino acid substitution in such a CDR according to b) and/or c) is preferably, and compared to the corresponding CDR according to a), a conservative amino acid substitution (as defined herein);
and/or
the CDR according to b) and/or c) preferably only contains amino acid substitutions, and no amino acid deletions or insertions, compared to the corresponding CDR according to a);
and/or
the CDR according to b) and/or c) may be a CDR that is derived from a CDR according to a) by means of affinity maturation using one or more techniques of affinity maturation known per se.

Similarly, when a Nanobody of the invention contains one or more CDR2 sequences according to e) and/or f):
any amino acid substitution in such a CDR according to e) and/or f) is preferably, and compared to the corresponding CDR according to d), a conservative amino acid substitution (as defined herein);
and/or
the CDR according to e) and/or f) preferably only contains amino acid substitutions, and no amino acid deletions or insertions, compared to the corresponding CDR according to d);
and/or
the CDR according to e) and/or f) may be a CDR that is derived from a CDR according to d) by means of affinity maturation using one or more techniques of affinity maturation known per se.

Also, similarly, when a Nanobody of the invention contains one or more CDR3 sequences according to h) and/or i):
any amino acid substitution in such a CDR according to h) and/or i) is preferably, and compared to the corresponding CDR according to g), a conservative amino acid substitution (as defined herein);
and/or
the CDR according to h) and/or i) preferably only contains amino acid substitutions, and no amino acid deletions or insertions, compared to the corresponding CDR according to g);
and/or
the CDR according to h) and/or i) may be a CDR that is derived from a CDR according to g) by means of affinity maturation using one or more techniques of affinity maturation known per se.

It should be understood that the last three paragraphs generally apply to any Nanobody of the invention that comprises one or more CDR1 sequences, CDR2 sequences and/or CDR3 sequences according to b), c), e), f), h) or i), respectively.

Of the Nanobodies of the invention, Nanobodies comprising one or more of the CDR's explicitly listed above are particularly preferred; Nanobodies comprising two or more of the CDR's explicitly listed above are more particularly preferred; and Nanobodies comprising three of the CDR's explicitly listed above are most particularly preferred.

Some particularly preferred, but non-limiting combinations of CDR sequences, as well as preferred combinations of CDR sequences and framework sequences, are mentioned in Table A-1f below, which lists the CDR sequences and framework sequences that are present in a number of preferred (but non-limiting) Nanobodies of the invention. As will be clear to the skilled person, a combination of CDR1, CDR2 and CDR3 sequences that occur in the same clone (i.e. CDR1, CDR2 and CDR3 sequences that are mentioned on the same line in Table A-1f) will usually be preferred (although the invention in its broadest sense is not limited thereto, and also comprises other suitable combinations of the CDR sequences mentioned in Table A-1f). Also, a combination of CDR sequences and framework sequences that occur in the same clone (i.e. CDR sequences and framework sequences that are mentioned on the same line in Table A-1f) will usually be preferred (although the invention in its broadest sense is not limited thereto, and also comprises other suitable combinations of the CDR sequences and framework sequences mentioned in Table A-1f, as well as combinations of such CDR sequences and other suitable framework sequences, e.g. as further described herein).

Also, in the Nanobodies of the invention that comprise the combinations of CDR's mentioned in Table A-1f, each CDR can be replaced by a CDR chosen from the group consisting of amino acid sequences that have at least 80%, preferably at least 90%, more preferably at least 95%, even more preferably at least 99% sequence identity (as defined herein) with the mentioned CDR's; in which:

i) any amino acid substitution in such a CDR is preferably, and compared to the corresponding CDR sequence mentioned in Table A-1f, a conservative amino acid substitution (as defined herein);

and/or ii) any such CDR sequence preferably only contains amino acid substitutions, and no amino acid deletions or insertions, compared to the corresponding CDR sequence mentioned in Table A-1f;

and/or iii) any such CDR sequence is a CDR that is derived by means of a technique for affinity maturation known per se, and in particular starting from the corresponding CDR sequence mentioned in Table A-1f.

However, as will be clear to the skilled person, the (combinations of) CDR sequences, as well as (the combinations of) CDR sequences and framework sequences mentioned in Table A-1f will generally be preferred.

TABLE A-1f

Preferred combinations of CDR sequences, preferred combinations of framework sequences, and preferred combinations of framework and CDR sequences for Nanobodies against CD28. ("ID" refers to the SEQ ID NO in the attached sequence listing)

| Clone | ID FR1 | ID CDR 1 | ID FR2 | ID CDR 2 | ID FR3 | ID CDR 3 | ID FR4 |
|---|---|---|---|---|---|---|---|
| 65C2 | 512 EVQLVESGGGLVQAGGSLRLSCAASGLTFS | 518 NYVMG | 524 WFRQAPGKEREFVG | 530 TISWDGSDTYYTHSVKG | 536 RFTISRDNAKNVVNLQMNSLKPEDTAVYYCAA | 542 DYRPGGLLSLGKNEYDY | 548 WGQGTQVTVSS |
| 70F9 | 513 EVQLVESGGGLVQAGGSLRLSCAASGRTFS | 519 SYVMG | 525 WFRQAPGKEREFVA | 531 AHSWYADYADSVKG | 537 RFSISRDNDKNTVYLQMNSLKPEDTAVYYCAA | 543 SRSQGRRYANSYES | 549 WGQGTQVTVSS |
| 65B2 | 514 EVQLVESGGGLVQAGGSLRLSCATSGRTFS | 520 SDVMG | 526 WFRQAPGKEREFVA | 532 AINRSGHSTSYTGSVKG | 538 RFAISRDNTKNTVYLQMNSLKPEDTAVYYCAL | 544 RLWSDYLAQKSGEYNY | 550 WGQGTQVTVSS |
| 65C4 | 515 EVQLVESGGGLVQAGGSLRLSCKAAGRTFS | 521 SYAMG | 527 WFRQAPGKEREFVA | 533 SIEWDGGGAYYEEAVKG | 539 RFTISRDNTKNTVYLQMDSLRPEDTAVYYCAA | 545 SRWRTALTNYYDVAD | 551 WGQGTQVTVSS |
| 65G2 | 516 EVQLVESGGGLVQPGGSLRLSCAASGFTLD | 522 AYAIH | 528 WFRQAPGKEREGVS | 534 CISSSDGSTYYANSVKG | 540 RFTISRDNAKNAVYLQMNSLKPEDTAVYYCAT | 546 AKRCWGLSYEYDY | 552 WGQGTQVTVSS |
| 70F10 | 517 EVQLVESGGGLVQAGGSLRLSCAASGFTFD | 523 DYAIG | 529 WFRQAPGKEREGVA | 535 CVSNSDGSTYYANSVKG | 541 RFTISSDNAKNTVYLQMNSLKPEDTAVYYCAA | 547 DSRCWGWGMLHMRHGD | 553 RGQGTQVTVSS |

Thus, in the Nanobodies of the invention, at least one of the CDR1, CDR2 and CDR3 sequences present is suitably chosen from the group consisting of the CDR1, CDR2 and CDR3 sequences, respectively, listed in Table A-1f; or from the group of CDR1, CDR2 and CDR3 sequences, respectively, that have at least 80%, preferably at least 90%, more preferably at least 95%, even more preferably at least 99% "sequence identity" (as defined herein) with at least one of the CDR1, CDR2 and CDR3 sequences, respectively, listed in Table A-1f; and/or from the group consisting of the CDR1, CDR2 and CDR3 sequences, respectively, that have 3, 2 or only 1 "amino acid difference(s)" (as defined herein) with at least one of the CDR1, CDR2 and CDR3 sequences, respectively, listed in Table A-1f.

In this context, by "suitably chosen" is meant that, as applicable, a CDR1 sequence is chosen from suitable CDR1 sequences (i.e. as defined herein), a CDR2 sequence is chosen from suitable CDR2 sequences (i.e. as defined herein), and a CDR3 sequence is chosen from suitable CDR3 sequence (i.e. as defined herein), respectively. More in particular, the CDR sequences are preferably chosen such that the Nanobodies of the invention bind to CD28 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In particular, in the Nanobodies of the invention, at least the CDR3 sequence present is suitably chosen from the group consisting of the CDR3 sequences listed in Table A-1f or from the group of CDR3 sequences that have at least 80%, preferably at least 90%, more preferably at least 95%, even more preferably at least 99% sequence identity with at least one of the CDR3 sequences listed in Table A-1f; and/or from the group consisting of the CDR3 sequences that have 3, 2 or only 1 amino acid difference(s) with at least one of the CDR3 sequences listed in Table A-1f.

Preferably, in the Nanobodies of the invention, at least two of the CDR1, CDR2 and CDR3 sequences present are suitably chosen from the group consisting of the CDR1, CDR2 and CDR3 sequences, respectively, listed in Table A-1f or from the group consisting of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table A-1f; and/or from the group consisting of the CDR1, CDR2 and CDR3 sequences, respectively, that have 3, 2 or only 1 "amino acid difference(s)" with at least one of the CDR1, CDR2 and CDR3 sequences, respectively, listed in Table A-1f.

In particular, in the Nanobodies of the invention, at least the CDR3 sequence present is suitably chosen from the group consisting of the CDR3 sequences listed in Table A-1f or from the group of CDR3 sequences that have at least 80%, preferably at least 90%, more preferably at least 95%, even more preferably at least 99% sequence identity with at least one of the CDR3 sequences listed in Table A-1f, respectively; and at least one of the CDR1 and CDR2 sequences present is suitably chosen from the group consisting of the CDR1 and CDR2 sequences, respectively, listed in Table A-1f or from the group of CDR1 and CDR2 sequences, respectively, that have at least 80%, preferably at least 90%, more preferably at least 95%, even more preferably at least 99% sequence identity with at least one of the CDR1 and CDR2 sequences, respectively, listed in Table A-1f; and/or from the group consisting of the CDR1 and CDR2 sequences, respectively, that have 3, 2 or only 1 amino acid difference(s) with at least one of the CDR1 and CDR2 sequences, respectively, listed in Table A-1f.

Most preferably, in the Nanobodies of the invention, all three CDR1, CDR2 and CDR3 sequences present are suitably chosen from the group consisting of the CDR1, CDR2 and CDR3 sequences, respectively, listed in Table A-1f or from the group of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table A-1f; and/or from the group consisting of the CDR1, CDR2 and CDR3 sequences, respectively, that have 3, 2 or only 1 amino acid difference(s) with at least one of the CDR1, CDR2 and CDR3 sequences, respectively, listed in Table A-1f.

Even more preferably, in the Nanobodies of the invention, at least one of the CDR1, CDR2 and CDR3 sequences present is suitably chosen from the group consisting of the CDR1, CDR2 and CDR3 sequences, respectively, listed in Table A-1f. Preferably, in this aspect, at least one or preferably both of the other two CDR sequences present are suitably chosen from CDR sequences that have at least 80%, preferably at least 90%, more preferably at least 95%, even more preferably at least 99% sequence identity with at least one of the corresponding CDR sequences, respectively, listed in Table A-1f; and/or from the group consisting of the CDR sequences that have 3, 2 or only 1 amino acid difference(s) with at least one of the corresponding sequences, respectively, listed in Table A-1f.

In particular, in the Nanobodies of the invention, at least the CDR3 sequence present is suitably chosen from the group consisting of the CDR3 listed in Table A-1f. Preferably, in this aspect, at least one and preferably both of the CDR1 and CDR2 sequences present are suitably chosen from the groups of CDR1 and CDR2 sequences, respectively, that have at least 80%, preferably at least 90%, more preferably at least 95%, even more preferably at least 99% sequence identity with the CDR1 and CDR2 sequences, respectively, listed in Table A-1f; and/or from the group consisting of the CDR1 and CDR2 sequences, respectively, that have 3, 2 or only 1 amino acid difference(s) with at least one of the CDR1 and CDR2 sequences, respectively, listed in Table A-1f.

Even more preferably, in the Nanobodies of the invention, at least two of the CDR1, CDR2 and CDR3 sequences present are suitably chosen from the group consisting of the CDR1, CDR2 and CDR3 sequences, respectively, listed in Table A-1f. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table A-1f; and/or from the group consisting of CDR sequences that have 3, 2 or only 1 amino acid difference(s) with at least one of the corresponding sequences listed in Table A-1f.

In particular, in the Nanobodies of the invention, at least the CDR3 sequence is suitably chosen from the group consisting of the CDR3 sequences listed in Table A-1f, and either the CDR1 sequence or the CDR2 sequence is suitably chosen from the group consisting of the CDR1 and CDR2 sequences, respectively, listed in Table A-1f. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table A-1f, and/or from the group consisting of CDR sequences that have 3, 2 or only 1 amino acid difference(s) with the corresponding CDR sequences listed in Table A-1f.

Even more preferably, in the Nanobodies of the invention, all three CDR1, CDR2 and CDR3 sequences present are suitably chosen from the group consisting of the CDR1, CDR2 and CDR3 sequences, respectively, listed in Table A-1f.

Also, generally, the combinations of CDR's listed in Table A-1f (i.e. those mentioned on the same line in Table A-1f) are preferred. Thus, it is generally preferred that, when a CDR in a Nanobody of the invention is a CDR sequence mentioned in Table A-1f or is suitably chosen from the group of CDR sequences that have at least 80%, preferably at least 90%, more preferably at least 95%, even more preferably at least 99% sequence identity with a CDR sequence listed in Table A-1f; and/or from the group consisting of CDR sequences that have 3, 2 or only 1 amino acid difference(s) with a CDR sequence listed in Table A-1f, that at least one and preferably both of the other CDR's are suitably chosen from the CDR sequences that belong to the same combination in Table A-1f (i.e. mentioned on the same line in Table A-1f) or are suitably chosen from the group of CDR sequences that have at least 80%, preferably at least 90%, more preferably at least 95%, even more preferably at least 99% sequence identity with the CDR sequence(s) belonging to the same combination and/or from the group consisting of CDR sequences that have 3, 2 or only 1 amino acid difference(s) with the CDR sequence(s) belonging to the same combination. The other preferences indicated in the above paragraphs also apply to the combinations of CDR's mentioned in Table A-1f.

Thus, by means of non-limiting examples, a Nanobody of the invention can for example comprise a CDR1 sequence that has more than 80% sequence identity with one of the CDR1 sequences mentioned in Table A-1f, a CDR2 sequence that has 3, 2 or 1 amino acid difference with one of the CDR2 sequences mentioned in Table A-1f (but belonging to a different combination), and a CDR3 sequence.

Some preferred Nanobodies of the invention may for example comprise: (1) a CDR1 sequence that has more than 80% sequence identity with one of the CDR1 sequences mentioned in Table A-1f; a CDR2 sequence that has 3, 2 or 1 amino acid difference with one of the CDR2 sequences mentioned in Table A-1f (but belonging to a different combination); and a CDR3 sequence that has more than 80% sequence identity with one of the CDR3 sequences mentioned in Table A-1f (but belonging to a different combination); or (2) a CDR1 sequence that has more than 80% sequence identity with one of the CDR1 sequences mentioned in Table A-1f; a CDR2 sequence, and one of the CDR3 sequences listed in Table A-1f; or (3) a CDR1 sequence; a CDR2 sequence that has more than 80% sequence identity with one of the CDR2 sequence listed in Table A-1f; and a CDR3 sequence that has 3, 2 or 1 amino acid differences with the CDR3 sequence mentioned in Table A-1f that belongs to the same combination as the CDR2 sequence.

Some particularly preferred Nanobodies of the invention may for example comprise: (1) a CDR1 sequence that has more than 80% sequence identity with one of the CDR1 sequences mentioned in Table A-1f, a CDR2 sequence that has 3, 2 or 1 amino acid difference with the CDR2 sequence mentioned in Table A-1f that belongs to the same combination; and a CDR3 sequence that has more than 80% sequence identity with the CDR3 sequence mentioned in Table A-1f that belongs to the same combination; (2) a CDR1 sequence; a CDR 2 listed in Table A-1f and a CDR3 sequence listed in Table A-1f (in which the CDR2 sequence and CDR3 sequence may belong to different combinations).

Some even more preferred Nanobodies of the invention may for example comprise: (1) a CDR1 sequence that has more than 80% sequence identity with one of the CDR1 sequences mentioned in Table A-1f; the CDR2 sequence listed in Table A-1f that belongs to the same combination; and a CDR3 sequence mentioned in Table A-1f that belongs to a different combination; or (2) a CDR1 sequence mentioned in Table A-1f; a CDR2 sequence that has 3, 2 or 1 amino acid differences with the CDR2 sequence mentioned in Table A-1f that belongs to the same combination; and a CDR3 sequence that has more than 80% sequence identity with the CDR3 sequence listed in Table A-1f that belongs to the same or a different combination.

Particularly preferred Nanobodies of the invention may for example comprise a CDR1 sequence mentioned in Table A-1f, a CDR2 sequence that has more than 80% sequence identity with the CDR2 sequence mentioned in Table A-1f that belongs to the same combination; and the CDR3 sequence mentioned in Table A-1f that belongs to the same combination.

In the most preferred Nanobodies of the invention, the CDR1, CDR2 and CDR3 sequences present are suitably chosen from one of the combinations of CDR1, CDR2 and CDR3 sequences, respectively, listed in Table A-1f.

According to another preferred, but non-limiting aspect of the invention (a) CDR1 has a length of between 1 and 12 amino acid residues, and usually between 2 and 9 amino acid residues, such as 5, 6 or 7 amino acid residues; and/or (b) CDR2 has a length of between 13 and 24 amino acid residues, and usually between 15 and 21 amino acid residues, such as 16 and 17 amino acid residues; and/or (c) CDR3 has a length of between 2 and 35 amino acid residues, and usually between 3 and 30 amino acid residues, such as between 6 and 23 amino acid residues.

In another preferred, but non-limiting aspect, the invention relates to a Nanobody in which the CDR sequences (as defined herein) have more than 80%, preferably more than 90%, more preferably more than 95%, such as 99% or more sequence identity (as defined herein) with the CDR sequences of at least one of the amino acid sequences of SEQ ID NO's: 554-559.

Generally, Nanobodies with the above CDR sequences may be as further described herein, and preferably have framework sequences that are also as further described herein. Thus, for example and as mentioned herein, such Nanobodies may be naturally occurring Nanobodies (from any suitable species), naturally occurring $V_{HH}$ sequences (i.e. from a suitable species of Camelid) or synthetic or semi-synthetic amino acid sequences or Nanobodies, including but not limited to partially humanized Nanobodies or $V_{HH}$ sequences, fully humanized Nanobodies or $V_{HH}$ sequences, camelized heavy chain variable domain sequences, as well as Nanobodies that have been obtained by the techniques mentioned herein.

Thus, in one specific, but non-limiting aspect, the invention relates to a humanized Nanobody, which consists of 4 framework regions (FR1 to FR4 respectively) and 3 complementarity determining regions (CDR1 to CDR3 respectively), in which CDR1 to CDR3 are as defined herein and in which said humanized Nanobody comprises at least one humanizing substitution (as defined herein), and in particular at least one humanizing substitution in at least one of its framework sequences (as defined herein).

In another preferred, but non-limiting aspect, the invention relates to a Nanobody in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 554-559. This degree of amino acid identity can for example be determined by determining the degree of amino acid identity (in a manner described herein) between said Nanobody and one or more of the sequences of SEQ ID NO's: 554-559, in which the amino acid residues that form the framework regions are disregarded. Such Nanobodies can be as further described herein.

In another preferred, but non-limiting aspect, the invention relates to a Nanobody with an amino acid sequence that is chosen from the group consisting of SEQ ID NO's: 554-559 or from the group consisting of from amino acid sequences that have more than 80%, preferably more than 90%, more preferably more than 95%, such as 99% or more sequence identity (as defined herein) with at least one of the amino acid sequences of SEQ ID NO's: 554-559.

Another preferred, but non-limiting aspect of the invention relates to humanized variants of the Nanobodies of SEQ ID NO's: 554-559, that comprise, compared to the corresponding native $V_{HH}$ sequence, at least one humanizing substitution (as defined herein), and in particular at least one humanizing substitution in at least one of its framework sequences (as defined herein).

In a preferred but non-limiting aspect, the invention relates to a Nanobody (as defined herein) against CTLA4, which consists of 4 framework regions (FR1 to FR4 respectively) and 3 complementarity determining regions (CDR1 to CDR3 respectively), in which:

CDR1 is chosen from the group consisting of:

a) the amino acid sequences of SEQ ID NO's: 664-767;

b) amino acid sequences that have at least 80% amino acid identity with at least one of the amino acid sequences of SEQ ID NO's: 664-767;

c) amino acid sequences that have 3, 2, or 1 amino acid difference with at least one of the amino acid sequences of SEQ ID NO's: 664-767;

and/or

CDR2 is chosen from the group consisting of:

d) the amino acid sequences of SEQ ID NO's: 872-975;

e) amino acid sequences that have at least 80% amino acid identity with at least one of the amino acid sequences of SEQ ID NO's: 872-975;

f) amino acid sequences that have 3, 2, or 1 amino acid difference with at least one of the amino acid sequences of SEQ ID NO's: 872-975;

and/or

CDR3 is chosen from the group consisting of:

g) the amino acid sequences of SEQ ID NO's: 1080-1183;

h) amino acid sequences that have at least 80% amino acid identity with at least one of the amino acid sequences of SEQ ID NO's: 1080-1183;

i) amino acid sequences that have 3, 2, or 1 amino acid difference with at least one of the amino acid sequences of SEQ ID NO's: 1080-1183;

or any suitable fragment of such an amino acid sequence.

In particular, according to this preferred but non-limiting aspect, the invention relates to a Nanobody (as defined herein) against CTLA4, which consists of 4 framework regions (FR1 to FR4 respectively) and 3 complementarity determining regions (CDR1 to CDR3 respectively), in which:

CDR1 is chosen from the group consisting of:

the amino acid sequences of SEQ ID NO's: 664-767;

amino acid sequences that have at least 80% amino acid identity with at least one of the amino acid sequences of SEQ ID NO's: 664-767;

amino acid sequences that have 3, 2, or 1 amino acid difference with at least one of the amino acid sequences of SEQ ID NO's: 664-767;

and
CDR2 is chosen from the group consisting of:
the amino acid sequences of SEQ ID NO's: 872-975;
amino acid sequences that have at least 80% amino acid identity with at least one of the amino acid sequences of SEQ ID NO's: 872-975;
amino acid sequences that have 3, 2, or 1 amino acid difference with at least one of the amino acid sequences of SEQ ID NO's: 872-975;
and
CDR3 is chosen from the group consisting of:
the amino acid sequences of SEQ ID NO's: 1080-1183;
amino acid sequences that have at least 80% amino acid identity with at least one of the amino acid sequences of SEQ ID NO's: 1080-1183;
amino acid sequences that have 3, 2, or 1 amino acid difference with at least one of the amino acid sequences of SEQ ID NO's: 1080-1183;
or any suitable fragment of such an amino acid sequences.

As generally mentioned herein for the amino acid sequences of the invention, when a Nanobody of the invention contains one or more CDR1 sequences according to b) and/or c):

i) any amino acid substitution in such a CDR according to b) and/or c) is preferably, and compared to the corresponding CDR according to a), a conservative amino acid substitution (as defined herein);
and/or
ii) the CDR according to b) and/or c) preferably only contains amino acid substitutions, and no amino acid deletions or insertions, compared to the corresponding CDR according to a);
and/or
iii) the CDR according to b) and/or c) may be a CDR that is derived from a CDR according to a) by means of affinity maturation using one or more techniques of affinity maturation known per se.

Similarly, when a Nanobody of the invention contains one or more CDR2 sequences according to e) and/or f):

i) any amino acid substitution in such a CDR according to e) and/or f) is preferably, and compared to the corresponding CDR according to d), a conservative amino acid substitution (as defined herein);
and/or
ii) the CDR according to e) and/or f) preferably only contains amino acid substitutions, and no amino acid deletions or insertions, compared to the corresponding CDR according to d);
and/or
iii) the CDR according to e) and/or f) may be a CDR that is derived from a CDR according to d) by means of affinity maturation using one or more techniques of affinity maturation known per se.

Also, similarly, when a Nanobody of the invention contains one or more CDR3 sequences according to h) and/or i):

i) any amino acid substitution in such a CDR according to h) and/or i) is preferably, and compared to the corresponding CDR according to g), a conservative amino acid substitution (as defined herein);
and/or
ii) the CDR according to h) and/or i) preferably only contains amino acid substitutions, and no amino acid deletions or insertions, compared to the corresponding CDR according to g);
and/or
iii) the CDR according to h) and/or i) may be a CDR that is derived from a CDR according to g) by means of affinity maturation using one or more techniques of affinity maturation known per se.

It should be understood that the last three paragraphs generally apply to any Nanobody of the invention that comprises one or more CDR1 sequences, CDR2 sequences and/or CDR3 sequences according to b), c), e), f), h) or i), respectively.

Of the Nanobodies of the invention, Nanobodies comprising one or more of the CDR's explicitly listed above are particularly preferred; Nanobodies comprising two or more of the CDR's explicitly listed above are more particularly preferred; and Nanobodies comprising three of the CDR's explicitly listed above are most particularly preferred.

Some particularly preferred, but non-limiting combinations of CDR sequences, as well as preferred combinations of CDR sequences and framework sequences, are mentioned in Table A-1g below, which lists the CDR sequences and framework sequences that are present in a number of preferred (but non-limiting) Nanobodies of the invention. As will be clear to the skilled person, a combination of CDR1, CDR2 and CDR3 sequences that occur in the same clone (i.e. CDR1, CDR2 and CDR3 sequences that are mentioned on the same line in Table A-1g) will usually be preferred (although the invention in its broadest sense is not limited thereto, and also comprises other suitable combinations of the CDR sequences mentioned in Table A-1g). Also, a combination of CDR sequences and framework sequences that occur in the same clone (i.e. CDR sequences and framework sequences that are mentioned on the same line in Table A-1g) will usually be preferred (although the invention in its broadest sense is not limited thereto, and also comprises other suitable combinations of the CDR sequences and framework sequences mentioned in Table A-1g, as well as combinations of such CDR sequences and other suitable framework sequences, e.g. as further described herein).

Also, in the Nanobodies of the invention that comprise the combinations of CDR's mentioned in Table A-1g, each CDR can be replaced by a CDR chosen from the group consisting of amino acid sequences that have at least 80%, preferably at least 90%, more preferably at least 95%, even more preferably at least 99% sequence identity (as defined herein) with the mentioned CDR's; in which:

i) any amino acid substitution in such a CDR is preferably, and compared to the corresponding CDR sequence mentioned in Table A-1g, a conservative amino acid substitution (as defined herein);
and/or
ii) any such CDR sequence preferably only contains amino acid substitutions, and no amino acid deletions or insertions, compared to the corresponding CDR sequence mentioned in Table A-1g;
and/or
iii) any such CDR sequence is a CDR that is derived by means of a technique for affinity maturation known per se, and in particular starting from the corresponding CDR sequence mentioned in Table A-1g.

However, as will be clear to the skilled person, the (combinations of) CDR sequences, as well as (the combinations of) CDR sequences and framework sequences mentioned in Table A-1g will generally be preferred.

TABLE A-1g

Preferred combinations of CDR sequences, preferred combinations of framework sequences, and preferred combinations of framework and CDR sequences of Nanobodies against CTLA4. ("ID" refers to the SEQ ID NO in the attached sequence listing)

| Clone | ID FR1 | ID CDR 1 | ID FR2 | ID CDR 2 |
|---|---|---|---|---|
| 65H7 | 560 EVQLVESGGGLVQPGGSLRLSCAASGSILS | 664 IAVAG | 768 WYRRQPGKERELVA | 872 TISPGNNTHYVDSVKG |
| 65D10 | 561 EVQLVESGGGLVQAGGSLRLSCAASGRTSS | 665 TATVG | 769 WFRQAPGKEREFVA | 873 VINWRSGFTYYADSVKG |
| 69A4 | 562 EVQLVESGGGLVQAGGSLRLSCAASGGTFS | 666 SYAMG | 770 WFRQAPGKEREFVA | 874 AISPSGLTSYKDSVVG |
| 66B5 | 563 EVQLVESGGGLVQPGESLRLSCAASKSIFS | 667 ISVMA | 771 WYRQAPGKQRELVA | 875 RITPGGNTNYVDSVQG |
| 66B6 | 564 EVQLVESGGGLVQAGGSLRLSCAAPGRTFS | 668 NYAMG | 772 WFRQAPGKGREFVA | 876 DIRWSDGRTYYADSVKG |
| 66G2 | 565 EVQLVESGGGLVQPGGSLRLSCAASGFTLD | 669 YYAIG | 773 WFRQAPGKEREGVS | 877 CIDSSDGSTYYADSVKG |
| 69D9 | 566 EVQLVESGGGLVQTGGSLRLSCAASGRTFS | 670 SYTMG | 774 WFRQAPGKDREFVA | 878 AISRSGSLTSYADSVKG |
| 65F9 | 567 EVQLVESGGGLVQAGGSLRLSCAASGRTLT | 671 TYIMG | 775 WFRQAPGKEREFVA | 879 ATSPSGTLTSYADSVKG |
| 4CTLAPMP11E3 | 568 EVQLVESGGGLVEPGGSLRLSCAASGSISS | 672 YNVMG | 776 WYRQAPGQQRDLVA | 880 HIASNGEIMYADSAKG |
| 4CTLAPMP12H2 | 569 evqlvesggglvepggslrlscaasgsiss | 673 YNVMG | 777 wyrqapgqqrdiva | 881 HIASNGEIMYADSAKG |
| 4CTLAPMP33H10 | 570 EVQLVESGGGLVEPGGSLRLSCAASGSISS | 674 FNVMG | 778 WYRQAPGQQRDLVA | 882 HIASNGEIMYADSVKG |
| 4CTLAPMP29A4 | 571 EVQLVESGGGLVQTGGSLRLSCAASGSISS | 675 FNVMG | 779 WYRQAPGKQRDLVA | 883 HIASGGEIMYTDSVKG |
| 4CTLAPMP17C6 | 572 EVQLVESGGGLVQPGGSLRLSCAASGFTLD | 676 YYAIG | 780 WFRQAPGKEREGVS | 884 CIVGSDGSTYYADSVKG |
| 4CTLAPMP22D10CL7 | 573 EVQLVESGGGLVQPGGSLRLSCAASGFTLD | 677 YYAIG | 781 WFRQAPGKEREGVS | 885 CIDSSDGSTYYADSVKG |
| 4CTLAPMP32E2 | 574 EVQLVESGGGLVQPGGSLRLSCAASGFTLD | 678 YYAIG | 782 WFRQAPGKEREGVS | 886 CISLSDGSTYYADSVKG |
| 4CTLAPMP20F4CL8 | 575 EVQLVESGGGLVQPGGSLRLSCAASGFTLD | 679 YYAIG | 783 WFRQAPGKEREGVS | 887 CIVSSDGSTYYADSVKG |
| 4CTLAPMP29F7 | 576 EVQLVESGGGLVQPGGSLRLSCAASGFTLD | 680 YYAIG | 784 WFRQAPGKEREGVS | 888 CITISDGDTYYADSVKG |
| 4CTLAPMP10C5 | 577 EVQLVESGGGLVQPGGSLRLSCAASGFTLD | 681 YYAIG | 785 WFRQAPGKEREGVS | 889 CITISDGDTYYADSVKG |

TABLE A-1g-continued

Preferred combinations of CDR sequences, preferred combinations of framework sequences, and preferred combinations of framework and CDR sequences of Nanobodies against CTLA4.
("ID" refers to the SEQ ID NO in the attached sequence listing)

| | | | | | | | | |
|---|---|---|---|---|---|---|---|---|
| 4CTLAPM P11F1 | 578 | EVQLVESGGGL VQAGGSLRLSC AASGGTFS | 682 | FYGMG | 786 | WFRQAPG KEQEFVA | 890 | DIRTSA GRTYYA DSVKG |
| 4CTLAPM P29F2 | 579 | EMQLVESGGG LVQAGGSLRLS CAASGGTFS | 683 | FYGMG | 787 | WFRQAPG KEQEFVA | 891 | DIRTSA GRTYYA DSVKG |
| 4CTLAPM P03C4 | 580 | EVQLVESGGGL VQAGGSLRLSC AASGGTFS | 684 | FYGMG | 788 | WFRQAPG KEREFVA | 892 | DIRTSA GRTYYA DSVKG |
| 4CTLAPM P32F8 | 581 | EVQLVESGGGL VQAGGSLRLSC AASGGTFS | 685 | SYGMG | 789 | WFRQAPG KEREFVA | 893 | DIRSSA GRTYYA GSVKG |
| 4CTLAPM P07F11 | 582 | EVQLVESGGGL VQAGGSLRLSC AAPGRTFS | 686 | NYAMG | 790 | WFRQAPG KGREFVA | 894 | DIRWSD GRTYYA DSVKG |
| 4CTLAPM P02C7 | 583 | EVQLVESGGGL VQAGGSLRLSC AAPGRTFS | 687 | NYAMG | 791 | WFRQAPG KGREFVA | 895 | DIRWSD GRTYYA DSVKG |
| 4CTLAPM P03A6 | 584 | EVQLVESGGGL VQPGGSLRLSC AAPGRTFS | 688 | NYAMG | 792 | WFRQAPG KGREFVA | 896 | DIRWSD GRTYYA DSVKG |
| 4CTLAPM P1382 | 585 | EVQLVESGGGL VQPGGSLRLSC VASGIHFA | 689 | ISTIN | 793 | WYRQAPG KQRESVA | 897 | AITGTS VTGYAD SVKG |
| 4CTLAPM P03G3 | 586 | evqlvesggglvqpa gslriscadsgsifs | 690 | INTMG | 794 | wyrqapgkqr elva | 898 | TITSSG STNYAD SVKG |
| 4CTLAPM P16D7 | 587 | EVQLVESGGGL VQPGGSLRLSC ADAGSIFS | 691 | INTMG | 795 | WYRQAPG KQRELVA | 899 | AITSGG STNYAD SVKG |
| 4CTLAPM P27D8 | 588 | KVQLVESGGGL VQPGGSLRLSC AASGSDFS | 692 | LNAMG | 796 | WYRQAPG KQRELVA | 900 | AITSGG STNYAD SVKG |
| 4CTLAPM P04B10 | 589 | EMQLVESGGG LVQPGGSLRLS CAASGNIFS | 693 | RYIMG | 797 | WYRQAPG KQRELVA | 901 | DITPGG NTNYAD SVKG |
| 4CTLAPM P04B12 | 590 | EVQLVESGGGL VQPGGSLRLSC AASGNIFS | 694 | RYIMG | 798 | WYRQAPG KERELVA | 902 | DITPGG NTNYAN SVKG |
| 4CTLAPM P06D2 | 591 | EVQLVESGGGL VQPGGSLRLSC TASGNIFS | 695 | RYIMG | 799 | WYRQAPG KQRELVA | 903 | DITPGG NTNYAD SVKG |
| 4CTLAPM P03B1 | 592 | EVQLVESGGGL VQPGGSLRLSC AASGNIFS | 696 | RYIMG | 800 | WYRQAPG KQRESVA | 904 | TITPGG NTDYAD SVKG |
| 4CTLAPM P03A7 | 593 | EVQLVESGGGL VQPGGSLRLSC AASGNIFT | 697 | RNVMG | 801 | WYRQAPG KQRDLVA | 905 | SITPGG NIYYAD SVKG |
| 4CTLAPM P04A3 | 594 | EVQLVESGGGL VQPGGSLRLSC AASGNIFT | 698 | RNIMG | 802 | WYRQAPG NQRDLVA | 906 | SITPGG NMYYA DSVKG |
| 4CTLAPM P02A1 | 595 | EVQLVESGGGL VQPGGSLRLSC AASGNIFT | 699 | RNVMG | 803 | WYRQAPG NQRDLVA | 907 | SITPGG NIYYAD SVKG |

TABLE A-1g-continued

Preferred combinations of CDR sequences, preferred combinations of framework sequences, and preferred combinations of framework and CDR sequences of Nanobodies against CTLA4.
("ID" refers to the SEQ ID NO in the attached sequence listing)

| | | | | |
|---|---|---|---|---|
| 4CTLAPM P08E5 | 596 EVQLVESGGGL VQPGGSLRLSC AASRDIFT | 700 RNIMG | 804 WYRQAPG KQRDLVA | 908 SITPGG NMYYA DSVKG |
| 4CTLAPM P03F7 | 597 EVQLVESGGGL VQPGGSLRLSC AASGNIFT | 701 RNIMG | 805 WYRQAPG KQRDLVA | 909 SITPGG NINYAD SVKG |
| 4CTLAPM P02C11 | 598 EVQLVESGGGL VQPGGSLRLSC AASGNIFT | 702 RHIMG | 806 WYRQAPG KQRELVA | 910 SITPGD NINYAD SVKG |
| 4CTLAPM P03B11 | 599 EVQLVESGGGL VQPGGSLRLSC AASGNIFT | 703 RNVMG | 807 WYRQAPG KQRDLVA | 911 SITPGG NINYAD SVKG |
| 4CTLAPM P02H3 | 600 EVQLVESGGGL VQPGGSLRLSC AASGRTSS | 704 TATVG | 808 WFRQAPG KEREFVA | 912 VINWRS GFTYYA DSVKG |
| 4CTLAPM P17E3 | 601 EVQLMESGGG LVTAGGSLRLS CAASGGTFG | 705 HYAMA | 809 WFRRPPG NEREFVA | 913 GIGWTY TTFYAD SVKG |
| 4CTLAPM P10G5 | 602 EVQLVESGGGL VQAGGSLRLSC AASGGTFS | 706 RYIMA | 810 WFRQAPG KEREFVA | 914 VIDSG YSTDYA GSVKG |
| 4CTLAPM P02G3 | 603 EVQLVESGGGL VQTGGSLRLSC AASGRTFS | 707 NYTMG | 811 WFRQAPG KDREFVA | 915 AISRSG SLKSYA DSVKG |
| 4CTLAPM P25H11 | 604 EVQLVESGGGL VQTGGSLRLSC AASGRTFS | 708 NYTMG | 812 WFRQAPG KDREFVA | 916 AISRSG NLKSYA DSVKG |
| 4CTLAPM P10A11 | 605 EVQLMESGGG LVQTGGSLRLS CVASGRTFS | 709 NYTMG | 813 WFRQAPG KDREFVA | 917 AISRSG SLKSYA DSVKG |
| 4CTLAPM P02F6 | 606 EVQLVESGGGL VQTGGSLRLSC AASGRTFS | 710 NVTMG | 814 WFRQAPG KDREFVA | 918 AISRSG GLKSYA DSVKG |
| 4CTLAPM P02F4 | 607 EVQLVESGGGL VQTGGSLRLSC AASGRTFS | 711 NYTMG | 815 WFRQAPG KDREFVA | 919 AISRSG ALKAYA DSVKG |
| 4CTLAPM P17C1 | 608 EVQLVESGGGL VQTGGSLRLSC AASGRTFS | 712 NYTMG | 816 WFRQAPG KDREFVA | 920 AISRSG SLKAYA DSVKG |
| 4CTLAPM P05E7 | 609 EVQLVESGGGL VQTGGSLRLSC AASGRTFS | 713 SYTMG | 817 WFRQAPG KDREFVT | 921 AISRSG TLTSYA DSVKG |
| 4CTLAPM P02F2 | 610 EVQLMESGGG LVQTGGSLRLS CAASGRTFS | 714 NYTMG | 818 WFRQAPG KDREFVA | 922 AISRSG SLKAYA DSVKG |
| 4CTLAPM P10F8 | 611 EVQLVESGGGL VQTGGSLRLSC AASGRTFS | 715 NYTMG | 819 WFRQAPG KDREFVA | 923 AISRSG SLKSYA DSVNG |
| 4CTLAPM P02F8 | 612 EVQLVESGGGL VQTGGSLRLSC AASGRTFS | 716 NYTMG | 820 WFRQAPG KDREFVA | 924 AISRSG NLKSYA DSVNG |
| 4CTLAPM P02E2 | 613 AVQLVESGGGL VQTGGSLRLSC AASGRTFS | 717 SYTMG | 821 WFRQAPG KDREYVA | 925 AISRSG SLKGYA DSVKG |

TABLE A-1g-continued

Preferred combinations of CDR sequences, preferred combinations of framework sequences, and preferred combinations of framework and CDR sequences of Nanobodies against CTLA4.
("ID" refers to the SEQ ID NO in the attached sequence listing)

| | | | | |
|---|---|---|---|---|
| 4CTLAPM P33D9 | 614 EVQLVESGGGL VQTGGSLRLSC AASGRTFS | 718 SYTMG | 822 WFRQAPG KDREYVA | 926 AISRSG SLKGYA DSVKG |
| 4CTLAPM P27C8 | 615 EVQLVESGGGL VQTGGSLRLSC AASGRTFS | 719 NYTMG | 823 WFRQAPG KDREFVA | 927 AISRSG TLKAYA DSVKG |
| 4CTLAPM P17D5 | 616 EVQLVESGGGL VQTGGSLRLSC AASGRTFS | 720 SYTTG | 824 WFRQAPG KDREFVA | 928 AISRSG SLTSYA DSVKG |
| 4CTLAPM P02H7 | 617 EVQLVESGGGL VQTGGSLRLSC AASGRTFS | 721 NYTMG | 825 WFRQAPG KDREFVA | 929 AISRSG SLKAYA DSVKG |
| 4CTLAPM P02G2 | 618 EVQLVESRGGL VQTGGSLRLSC AASGRTFS | 722 NYTMG | 826 WFRQAPG KDREFVA | 930 AISRSG SLKSYA DSVKG |
| 4CTLAPM P10D5 | 619 EVQLVESGGG VVQTGGSLRLS CAASGRTFS | 723 MYTMG | 827 WFRRAPG KDREFVA | 931 AISRSG GLKAVA DSVLG |
| 4CTLAPM P10G9 | 620 EVQLVESGGG VVQTGGSLRLS CAASGRTFS | 724 MYTMG | 828 WFRQAPG EDREFVA | 932 AISRSG GLKAYA DSVLG |
| 4CTLAPM P05G9 | 621 EVQLVESGGG VVQTGGSLRLS CAASGRTFS | 725 MYTMG | 829 WFRQAPG KDREFVA | 933 AISRSG GLKAYA DSVLG |
| 4CTLAPM P10B7 | 622 EVQLVESRGGL VQPGGSLRLSC AASGRAFN | 726 NYTMG | 830 WFRQAPG KDREFVA | 934 AISRSG NLKAYA DSVNG |
| 4CTLAPM P29B10 | 623 EVQPVESGGG LVQTGGSLRLS CAASGRTFS | 727 NYTMG | 831 WFRQAPG KDREFVA | 935 AISRSG NLKAYA DSVKG |
| 4CTLAPM P24E3 | 624 EVQLVESGGGL VQTGGSLRLSC AASGRAFN | 728 NYTMG | 832 WFRQAPG KDREFVA | 936 AISRSG NLKAYA DSVNG |
| 4CTLAPM P10F4 | 625 EVQLVESGGGL VQTGGSLRLSC AASGRAFN | 729 NYTMG | 833 WFRQAPG KDREFVA | 937 AISRSG NLKAYA DSVNG |
| 4CTLAPM P10F11 | 626 EVQLVESGGGL VQTGGSLRLSC AASGRTFS | 730 SYTMG | 834 WFRQAPG KDREFVA | 938 AISRSG GLTSYA DSVKG |
| 4CTLAPM P32B8 | 627 EVQLVESGGGL VQTGGSLRLSC AASGRAFN | 731 NYTMG | 835 WFRQAPG KDREFVA | 939 AISRSG NLKAYA DSVNG |
| 4CTLAPM P10G11 | 628 EVQLVESGGDL VQPGGSLRLSC AASGRTFS | 732 NYTVG | 836 WFRQAPG KDREFVT | 940 AISRSG SLKAYA DSVKD |
| 4CTLAPM P10B9 | 629 EVQLVESGGGL VQTGGSLRLSC AASGRTFS | 733 NYTVG | 837 WFRQAPG KDREFVT | 941 AISRSG SLKAYA DSVKD |
| 4CTLAPM P05G2 | 630 EVQLVESGGEL VQAGDSLRLSC AASGRTFS | 734 SYIMG | 838 WFRQAPG KEREFVA | 942 AISPSG ALTSYA DSVKG |
| 4CTLAPM P17H5 | 631 EVQLVESGGEL VQAGDSLRLSC AASGRTFS | 735 SYIMG | 839 WFRQAPG KEREFVA | 943 AISPSG ALTSYA DSVKG |

TABLE A-1g-continued

Preferred combinations of CDR sequences, preferred combinations of framework sequences, and preferred combinations of framework and CDR sequences of Nanobodies against CTLA4. ("ID" refers to the SEQ ID NO in the attached sequence listing)

| | | | | |
|---|---|---|---|---|
| 4CTLAPM P05E10 | 632 EVQLVESGGGL VQAGDSLRLSC AASGRTFS | 736 SYIMG | 840 WFRQAPG KEREFVA | 944 AISSSG ALTSYA DSVKG |
| 4CTLAPM P05E11 | 633 EVQLVESGGGL VQAGDSLRLSC AASGRTFS | 737 SYIMG | 841 WFRRAPG KEREFVA | 945 AISSSG ALTSYA DSVVG |
| 4CTLAPM P05E4 | 634 EVQLVESGGGL VQAGDSLTLSC AASGGTFS | 738 TYVMG | 842 WFRQASG KEREFVA | 946 AISPSG TLTSYA DSVKG |
| 4CTLAPM P17F6 | 635 EVGLVESGGGL VQAGDSLRLSC AASGRTFS | 739 SYVMG | 843 WFRQAPG KEREFVA | 947 AISSSG ALTSYA DSVYG |
| 4CTLAPM P10E11 | 636 EVGLVESGGGL VQAGDSLRLSC AASGRTFS | 740 NYVMG | 844 WFRQAPG KEREFVS | 948 AISPSG TLTSYT DSVKG |
| 4CTLAPM P17C5 | 637 EVQLVESGGGL VQAGDSLRLSC AASGRTFS | 741 SYVMG | 845 WFRQAPG KEREFVA | 949 AISPSG SLTSYA DSVKG |
| 4CTLAPM P11D1 | 638 EVQLVESGGGL VQAGGSLSLSC AASGRTFS | 742 SITMA | 846 WFRQTPG KEREFVA | 950 AISRSG SLTSYA DSLKG |
| 4CTLAPM P17C3 | 639 EVQLVESGGGL VQAGGSLGLSC AASGRSFS | 743 MYAMG | 847 WFRTAPG KEREFVA | 951 AISGSG TLTSVA DSVKG |
| 4CTLAPM P10A1 | 640 EVQLVESGGQL VQAGGSLRLSC AATGRTYN | 744 SYSLG | 848 WSRQAPG KEREFVA | 952 AISASG TLRAYA DSVKG |
| 4CTLAPM P31A8 | 641 EVQLVESGGQL VQAGDSLRLSC VATGRTYN | 745 SYSLG | 849 WSRQAPG KEREFVA | 953 AISASG TLRAYA DSVKG |
| 4CTLAPM P02H5 | 642 EVQLVESGGQL VQAGGSLRLSC AATGRTYN | 746 SYSLG | 850 WSRQAPG KEREFVA | 954 AISASG TLRAYA DSVKG |
| 4CTLAPM P10G3 | 643 EVQLVESGGQL VQAGGSLRLSC TATGHTYN | 747 TYPLG | 851 WFRQAPG KEREFVA | 955 AISPSG TLRAYA DSVKG |
| 4CTLAPM P05F10 | 644 EVQLVESGGQL VQAGGSLRLSC AATGRMYN | 748 SYSLG | 852 WSRQAPG KEREFVA | 956 AISASG TLRAYA DSVKG |
| 4CTLAPM P10B8 | 645 EVQLVESGGQL VQAGGSLRLSC AATGHTYN | 749 TYPLG | 853 WFRQAPG KEREFVA | 957 AISPSG TLRAYA DSVKG |
| 4CTLAPM P05H11 | 646 EVQLVESGGQL VQAGGSLRLSC AATGRTYN | 750 SYPLG | 854 WFRQAPG KEREFVA | 958 AISASG TLRAYA DSVKG |
| 4CTLAPM P17H9 | 647 EVQLVESGGQL VQAGGSLRLSC AATGRTYN | 751 SYSLG | 855 WFRQAPG KEHEFVA | 959 AISASG TLRAYA DSVKG |
| 4CTLAPM P2G9 | 648 EVQLVKSGGQL VQAGGSLRLSC AATGRTYN | 752 SYPLG | 856 WFRQAPG KEREFVA | 960 AISASG TLRAYA DSVKG |
| 4CTLAPM P10H5 | 649 EVQLVESGGQL VQAGGSLRLSC TATGHTFN | 753 TYPLA | 857 WFRQAPW KEREFVA | 961 AISPSG TLRAYA DSVKG |

TABLE A-1g-continued

Preferred combinations of CDR sequences, preferred combinations of framework sequences, and preferred combinations of framework and CDR sequences of Nanobodies against CTLA4. ("ID" refers to the SEQ ID NO in the attached sequence listing)

| Clone | ID | | ID | | ID | | ID | |
|---|---|---|---|---|---|---|---|---|
| 4CTLAPM P10B5 | 650 | EVQLVESGGQL VQAGGSLRLSC AATGRTYN | 754 | SYPLG | 858 | WFRQAPG KEREFVA | 962 | AISASG TLRAYA DSVKG |
| 4CTLAPM P02A2 | 651 | EVQLVESGGGL VQAGGSLRLSC AASGRTFS | 755 | NTLMG | 859 | WSRRAPG KEREFVA | 963 | AISGSG TLTSYA DSVKG |
| 4CTLAPM P02B8 | 652 | EVQLVESGGGL VQAGGSLRLSC AASGRTFS | 756 | NTLMG | 860 | WSRRAPG KEREFVA | 964 | AISGSG TLTSYA DSVKG |
| 4CTLAPM P02A5 | 653 | EVQLVESGGGL VQAGGSLRLSC AASGRTNS | 757 | TTLMG | 861 | WSRRAPG KEREFVA | 965 | AISGSG TLTSYA DSVKG |
| 4CTLAPM P02B11 | 654 | EVQLVESGGGL VQAGGSLRLSC AAPGRTNS | 758 | TTLMG | 862 | WSRRAPG KEREFVA | 966 | AISGSG TLTSYA DSVKG |
| 4CTLAPM P09C1 | 655 | EVQLVESGGGL VQPGGSLRLSC AASGRTNS | 759 | TTLMG | 863 | WSRRAPG KEREFVA | 967 | AISGSG TLTSYA DSVKG |
| 4CTLAPM P05C5 | 656 | EVQLVESGGGL VQAGGSLRLSC AASGRMFS | 760 | SRSIG | 864 | WFRQVPG KEREFVA | 968 | AISPSR SLKAYA DSVKG |
| 4CTLAPM P12B2 | 657 | EVQLVESGGGL VQAGGSLALSC AASGRMFS | 761 | SRSIG | 865 | WFRQAPG KDREFVA | 969 | AISPSG SLKAYA DSVKG |
| 4CTLAPM P17B5 | 658 | EVQLVESGGGL VQAGGSLRLSC AASGRTLT | 762 | TYIMG | 866 | WFRQAPG KEREFVA | 970 | ATSPSG TLTSYA DSVKG |
| 4CTLAPM P02B10 | 659 | EVQLVESEGGL VQPGGSLRLSC SASGRTFA | 763 | NNAMG | 867 | WFRQAPG KEREFVA | 971 | SISASG TLTSSA DSVKG |
| 4CTLAPM P02C9 | 660 | KVQLVESGGGL VQAGGSLRLSC SASGRTFA | 764 | NNAMG | 868 | WFRQAPG KEREFVA | 972 | SLSASG SLTSYA DSVNG |
| 4CTLAPM P04G10 | 661 | EVQLVESGGGL VKAGDSLRLSC SASGRTFA | 765 | NNAMG | 869 | WFRQAPG KEREFVA | 973 | SISASG TLTSSA DSVRG |
| 4CTLAPM P17B6 | 662 | EVQLVESGGGL VQAGGSLRLSC VASAEGSF | 766 | STYV MA | 870 | WFRQAPG KEREFAA | 974 | AISGRS GLTSYA DSVKG |
| 4CTLAPM P06C10 | 663 | EVQLVESGGGL VQAGGSLRLSC AASGRTF | 767 | SNYTIA | 871 | yfrqapgreref aa | 975 | AISPHG TLRSFA DSVKD |

| Clone | ID | FR3 | ID | CDR 3 | ID | FR4 |
|---|---|---|---|---|---|---|
| 65H7 | 976 | RFTISRDNAKNTV YLQMTTLKPDDTA AYYCNA | 1080 | KGSILLNAFDY | 1184 | WGKGTQVTVSS |
| 65D10 | 977 | RFTISREYAKNTV YLQMDSLKPEDT AVYSCAA | 1081 | DLGGRTLYG GIHYSPEEYAY | 1185 | WGQGTQVTVSS |
| 69A4 | 978 | RFTISRDNAKNTV YLQMNSLKPEDT AVHYCAA | 1082 | GQWTWSPL RVSRLAEYNY | 1186 | WGQGTQVTVSS |
| 66B5 | 979 | RFTISRDNAKNTV YLQMNSLKPEDT AVYYCNA | 1083 | QGSLLLAKY DY | 1187 | YGQGTQVTVSS |

TABLE A-1g-continued

Preferred combinations of CDR sequences, preferred combinations of framework sequences, and preferred combinations of framework and CDR sequences of Nanobodies against CTLA4. ("ID" refers to the SEQ ID NO in the attached sequence listing)

| Name | ID | Sequence | ID | Sequence | ID | Sequence |
|---|---|---|---|---|---|---|
| 66B6 | 980 | RFTVSRDNAKNTVYLQMNSLKPEDTAVYYCAA | 1084 | QGGVLSGWDY | 1188 | WGQGTQVTVSS |
| 66G2 | 981 | RFTISRDNAKNTVYLQMNSLKPEDTAVYYCAA | 1085 | VHGLKLPTLRGLGGSYYLQARSYDY | 1189 | WGQGTQVTVSS |
| 69D9 | 982 | RFTISRDNAKKMAYLQMNSLKPEDTAVYYCAA | 1086 | APVPWGTRPSLLTYDS | 1190 | WGQGTQVTVSS |
| 65F9 | 983 | RFSMSRDNAKKMVDLQMNSLKPEDTAVYYCAA | 1087 | KGGRWGPRNDDRYDY | 1191 | WGQGTQVTVSS |
| 4CTLAPMP11E3 | 984 | RFTISRDNAKKTVYLQMNSLKPEDTAVYYCKL | 1088 | WVLGNDY | 1192 | WGQGTQVTVSS |
| 4CTLAPMP12H2 | 985 | rFTISrdnakktvylqmnslkpedtavyyckl | 1089 | WVLGNDY | 1193 | wgqRtqVTVSS |
| 4CTLAPMP33H10 | 986 | RFTISRDNAKKTVYLQMNSLKPEDTAVYYCKL | 1090 | WVLGNDY | 1194 | WGQGTQVTVSS |
| 4CTLAPMP29A4 | 987 | RFTISRDNAKKTVYLQMNSLKPEDTAVYYCKL | 1091 | WVLGNDY | 1195 | WGQGTQVTVSS |
| 4CTLAPMP17C6 | 988 | RFTISRDNAKNTVYLQMNSLKPEDTAVYYCAA | 1092 | VHGLKLPTLRGLGGSYYLQARSYDY | 1196 | WGQGTQVTVSS |
| 4CTLAPMP22D10CL7 | 989 | RFTISRDNAKNTVYLQMNSLKPEDTAVYYCAA | 1093 | VHGLKLPTLRGLGGSYYLQARSYDY | 1197 | WGQGTQVTVSS |
| 4CTLAPMP32E2 | 990 | RFTISRDNAKNTVYLQMNSLKPEDTAVYYCAA | 1094 | VHGLKLPTLRGLGGSYYLQARSYDY | 1198 | WGQGTQVTVSS |
| 4CTLAPMP20F4CL8 | 991 | RFTISRDNAKNTVYLHMNSLKPEDTAVYYCAA | 1095 | VHGLKLPTLRGLGGSYYLQARSYDY | 1199 | WGQGTQVTVSS |
| 4CTLAPMP29F7 | 992 | RFTISRDNANNTVNLQMNSLKPEDTAVYYCAA | 1096 | VHGLKLPSQRGLGGSYYYLLPRSYDY | 1200 | WGQGTQVTVSS |
| 4CTLAPMP10C5 | 993 | RFTIARDYAKNTVYLQMNSLKPEDTAVYYCAA | 1097 | VHGLKLPSQRGLGGSYYYLLARSYDY | 1201 | WGQGTQVTVSS |
| 4CTLAPMP11F1 | 994 | RFTISRDNAKNTVYLQMNSLKPEDTAVYYCAA | 1098 | EMSGISGWDY | 1202 | WGQGTQVTVSS |
| 4CTLAPMP29F2 | 995 | RFTISRDNAKNTVYLQMNSLKPEDTAVYYCAA | 1099 | EMSGISGWDY | 1203 | WGQGTQVTVSS |
| 4CTLAPMP03C4 | 996 | RFTISRDNAKNTVYLQMNSLKPEDTAVYYCAA | 1100 | EMSGISGWDY | 1204 | WGQGTQVTVSS |
| 4CTLAPMP32F8 | 997 | RFTISRDNAKNTVYLQMNSLKPEDTAVYYCAA | 1101 | EMTGITGWDY | 1205 | WGQGTQVTVSS |

TABLE A-1g-continued

Preferred combinations of CDR sequences, preferred combinations of framework sequences, and preferred combinations of framework and CDR sequences of Nanobodies against CTLA4. ("ID" refers to the SEQ ID NO in the attached sequence listing)

| Name | ID | Sequence | ID | Sequence | ID | Sequence |
|---|---|---|---|---|---|---|
| 4CTLAPMP07F11 | 998 | RFTVSRDNAKNTVYLQMNSLKPEDTAVYYCAA | 1102 | QGGVLSGWDY | 1206 | WGQGTQVTVSS |
| 4CTLAPMP02C7 | 999 | RFTVSRDNAKNTVYLQMNSLKPEDTAVYYCAA | 1103 | QGGVLSGWDY | 1207 | WGQGTQVTVSS |
| 4CTLAPMP03A6 | 1000 | RFTVSRDNAKNTVYLQMNSLKPEDTAVYYCAA | 1104 | QGGVLSGWDY | 1208 | WGQGTQVTVSS |
| 4CTLAPMP1382 | 1001 | RFTLSRDNAKNTVYLQMDNLKPEDTAVYYCNV | 1105 | WSGRDY | 1209 | WGQGTQVTVSS |
| 4CTLAPMP03G3 | 1002 | rFTISrdnakntvytqmnslkpedtavyycna | 1106 | DYRDFGLSMERFIDFGS | 1210 | wgqgtqVTVSS |
| 4CTLAPMP16D7 | 1003 | RFTISRDNAKNTVYLQMNSLKPEDTAVYYCNA | 1107 | DYRDFGLSMERFTDFGS | 1211 | WGQGTQVTVSS |
| 4CTLAPMP27D8 | 1004 | RFTISRDNAKNTVYLQMNSLKPEDTAVYYCNA | 1108 | DYRDFGLSMERFVDFGS | 1212 | WGQGTQVTVSS |
| 4CTLAPMP04B10 | 1005 | RFTISRDGAKNTVGLQMNSLRPEDTAVYSCYA | 1109 | RGSDKLLMRTY | 1213 | WGQGTQVTVSS |
| 4CTLAPMP04B12 | 1006 | RFTISRDGAKNTVGLQMNSLRPDDTAVYSCYA | 1110 | RGSDKLLMRTY | 1214 | WGQGTQVTVSS |
| 4CTLAPMP06D2 | 1007 | RFSISRDGAKNTVDLQMNSLRPEDTAVYYCNA | 1111 | LGSDKLLIRTY | 1215 | WGQGTQVTVSS |
| 4CTLAPMP03B1 | 1008 | RFTISRDGAKNTVDLQMNSLKPEDTAVYYCNA | 1112 | RGSSGLSMSTY | 1216 | WGQGTQVTVSS |
| 4CTLAPMP03A7 | 1009 | RFTISRDGAKNTVYLQMNSLKPEDTAVYYCNA | 1113 | RGSILLDPINY | 1217 | WGQGTQVTVSS |
| 4CTLAPMP04A3 | 1010 | RFTISRDGAKNTVYLQMNSLKPEDTAVYYCNA | 1114 | RGSILLDPSNY | 1218 | WGQGTQVTVSS |
| 4CTLAPMP02A1 | 1011 | RFTISRDGAKSTVILQMNSLKPEDTAVYYCNA | 1115 | RGSILLDRVNY | 1219 | WGQGTQVTVSS |
| 4CTLAPMP08E5 | 1012 | RFTISRDGAKNTVYLQMNSLKPEDTAVYYCNA | 1116 | HGSILLDRSNY | 1220 | WGQGTQVTVSS |
| 4CTLAPMP03F7 | 1013 | RFTISRDGAKNTVYLQMNSLKPEDTAVYYCNA | 1117 | HGSILLNRSNY | 1221 | WGQGTQVTVSS |
| 4CTLAPMP02C11 | 1014 | RFTISRDGAKNTVYLQMNSLKPEDTAVYYCNA | 1118 | HGSILLDRTNY | 1222 | WGQGTQVTVSS |
| 4CTLAPMP03B11 | 1015 | RFTISRDGAKNTVYLQMNSLKPEDTAVYYCNA | 1119 | HGSILLDRIEY | 1223 | WGQGTQVTVSS |
| 4CTLAPMP02H3 | 1016 | RFTISREYAKNTVYLQMDSLKPEDTAVYSCAA | 1120 | DLGGRTLFGGIHYSPEEYAY | 1224 | WGQGTQVTVSS |

TABLE A-1g-continued

Preferred combinations of CDR sequences, preferred combinations of framework sequences, and preferred combinations of framework and CDR sequences of Nanobodies against CTLA4. ("ID" refers to the SEQ ID NO in the attached sequence listing)

| | | | | | |
|---|---|---|---|---|---|
| 4CTLAPM P17E3 | 1017 | RFAISRDNAENTV YLQMNNLKPDDT AVYYCAA | 1121 | AELKGRNLR VPDYEH | 1225 WGQGTQVTVSS |
| 4CTLAPM P10G5 | 1018 | RFTIARDNTKNTA YLQMNSLKPEDT ALYFCGA | 1122 | GRQYSTGPY WYDY | 1226 WGQGTQVTVSS |
| 4CTLAPM P02G3 | 1019 | RFTISRDNAKKMA YLQMLFLKLEDSA VYYCAA | 1123 | APVPWGTRP STFPYDS | 1227 WGQGTQVTVSS |
| 4CTLAPM P25H11 | 1020 | RFTISRDNAKKMA YLQMNSLKLEDTA VYYCAA | 1124 | APVPWGTRP STFPYDS | 1228 WGQGTQVTVSS |
| 4CTLAPM P10A11 | 1021 | RFTISRDNAKKMA YLQMLFLKLEDSA VYYCAA | 1125 | APVPWGTRP STFPYDS | 1229 WGQGTQVTVSS |
| 4CTLAPM P02F6 | 1022 | RFTISRDNAKKMA YLQMNSLKLEDTA VYYCAA | 1126 | APVPWGTRP STFPYDS | 1230 WGQGTQVTVSS |
| 4CTLAPM P02F4 | 1023 | RFTPSRDNAKKM AYLQMNSLKPED TAVYYCAA | 1127 | APVPWGTRP STFPYDS | 1231 WGQGTQVTVSS |
| 4CTLAPM P17C1 | 1024 | RFTPSRDNAKKM AYLQMNSLKPED TAVYYCAA | 1128 | APVPWGTRP SLFPYDS | 1232 WGQGTQVTVSS |
| 4CTLAPM P05E7 | 1025 | RFTISRDNAKKMA YLQMNSLKPEDT AVYYCAV | 1129 | APVPWGTRP SLFPYDS | 1233 WGQGTQVTVSS |
| 4CTLAPM P02F2 | 1026 | RFTPSRDNAKKM AYLQMNSLKPED TAVYYCAA | 1130 | APVPWGTRP SLFPYDS | 1234 WGQGTQVTVSS |
| 4CTLAPM P10F8 | 1027 | RFTISRDNAKKMA YLQMNSLKPEDT ASYYCAA | 1131 | APVPWGTRP SFLTVDS | 1235 WGQGTQVTVSS |
| 4CTLAPM P02F8 | 1028 | RFTISRDNAKKMA YLQMNSLKPEDT AVYYCAA | 1132 | APVPWGTRP SFLTYDS | 1236 WGQGTQVTVSS |
| 4CTLAPM P02E2 | 1029 | RFTISRDNAKNMA YLQMNSLKPEDT AVYYCAA | 1133 | APVPWGTRP SLLTYDS | 1237 WGQGTQVTVSS |
| 4CTLAPM P33D9 | 1030 | RFTISRDNAKNMA YLQMNSLKPEDT AVYYCAA | 1134 | APVPWGTRP SLLTYDS | 1238 WGQGTQVTVSS |
| 4CTLAPM P27C8 | 1031 | RFTISRDNAKKMA YLQMNSLKPEDT AVYYCAA | 1135 | APVPWGTRP SFFTYDS | 1239 WGQGTQVTVSS |
| 4CTLAPM P17D5 | 1032 | RFTISRDNAKKMA YLQMNSLKPEDA AVYYCAA | 1136 | APVPWGTRP SFFTYDS | 1240 WGQGTQVTVSS |
| 4CTLAPM P02H7 | 1033 | RFTISRDNAKKMA YLQMNSLKPEDT AVYYCAA | 1137 | APVPWGTRP SFFTYDS | 1241 WGQGTQVTVSS |
| 4CTLAPM P02G2 | 1034 | RFTISRDNAKKMA YLQMNSLKPEDT AVYYCAA | 1138 | APVPWGTRP SFFTYDS | 1242 WGQGTQVTVSS |

TABLE A-1g-continued

Preferred combinations of CDR sequences, preferred combinations of framework sequences, and preferred combinations of framework and CDR sequences of Nanobodies against CTLA4. ("ID" refers to the SEQ ID NO in the attached sequence listing)

| | | | | | | |
|---|---|---|---|---|---|---|
| 4CTLAPM P10D5 | 1035 | RFTISRDNANEMA YLQMNSLNPEDT AVYYCAA | 1139 | APVPWGTRP SHFTYDS | 1243 | WGQGTQVTVSS |
| 4CTLAPM P10G9 | 1036 | RFTISRDNANEMA YLQMNSLNPEDT AVYYCAA | 1140 | APVPWGTRP SHFTYDS | 1244 | WGQGTQVTVSS |
| 4CTLAPM P05G9 | 1037 | RFTISRDNANEMA YLQMNSLNPEDT AVYYCAA | 1141 | APVPWGTRP SHFTYDS | 1245 | WGQGTQVTVSS |
| 4CTLAPM P10B7 | 1038 | RFTISRDNAKKMA YLQMNSLKPEDT SVYYCTA | 1142 | APVPWGTRP SLFTYDS | 1246 | WGQGTQVTVSS |
| 4CTLAPM P29B10 | 1039 | RFTISRDNAKKMA YLQMNSLKPEDT AVYYCAA | 1143 | APVPWGTRP SLFTYDS | 1247 | WGQGTQVTVSS |
| 4CTLAPM P24E3 | 1040 | RFTISRDNAKEMA YLQMNSLKPEDT SVYYCTA | 1144 | APVPWGTRP SLFTYDS | 1248 | WGQGTQVTVSS |
| 4CTLAPM P10F4 | 1041 | RFTTSRDNAKKM AYLQMNSLKPED TSVYYCTA | 1145 | APVPWGTRP SLFTYDS | 1249 | WGQGTQVTVSS |
| 4CTLAPM P10F11 | 1042 | RFTISRDNGKKMA YLQMNSLKPEDT AVYYCAA | 1146 | APVPWGTRP SLFTYDS | 1250 | WGQGTQVTVSS |
| 4CTLAPM P32B8 | 1043 | RFTISRDNAKKMA YLQMNSLKPEDT SVYYCTA | 1147 | APVPWGTRP SLFTYDS | 1251 | WGQGTQVTVSS |
| 4CTLAPM P10G11 | 1044 | RFTISRDNAKKMA YLQMNSLKPEDT AVYYCAG | 1148 | APVPWGARP SLFTYDS | 1252 | WGQGTQVTVSS |
| 4CTLAPM P10B9 | 1045 | RFTISRDNAKKMA YLQMNSLKPEDT AVYYCAG | 1149 | APVPWGARP SLFTYDS | 1253 | WGQGTQVTVSS |
| 4CTLAPM P05G2 | 1046 | RFTISRDNAEKMV YLQMSSLKPEDT DVYYCAA | 1150 | ARVPWSPRP SLSPYDY | 1254 | WGQGTQVTVSS |
| 4CTLAPM P17H5 | 1047 | RFTISRDNAEKMV YLQMSSLKPEDT DAYYCAA | 1151 | ARVPWSPRP SLSPYDY | 1255 | WGQGTQVTVSS |
| 4CTLAPM P05E10 | 1048 | RFTISRDNAEKMV YLQMSSLKPEDT DVYYCAA | 1152 | ARVPWSPRP SLSTYDY | 1256 | WGQGTQVTVSS |
| 4CTLAPM P05E11 | 1049 | RFTISRDNAKKMV YLQMRSLKPEDT DVYYCAA | 1153 | ARVPWSPRP SLSTVDY | 1257 | WGQGTQVTVSS |
| 4CTLAPM P05E4 | 1050 | RFGISRDNAKKMV YLQVSSLKPEDTD VYYCAA | 1154 | ARGPWTPRP SLLTYDY | 1258 | WGQGTQVTVSS |
| 4CTLAPM P17F6 | 1051 | RFTISRDNAKKMV YLQMSSLKPEDT DVYYCAA | 1155 | GRGPWSPR PSLLTYDY | 1259 | WGQGTQVTVSS |
| 4CTLAPM P10E11 | 1052 | RFAISRDNAKKML YLQMSSLKPEDT DVYYCAA | 1156 | ARGPWSARP SLLTYDY | 1260 | WGQGTQVTVSS |

TABLE A-1g-continued

Preferred combinations of CDR sequences, preferred combinations of framework sequences, and preferred combinations of framework and CDR sequences of Nanobodies against CTLA4.
("ID" refers to the SEQ ID NO in the attached sequence listing)

| Clone | ID | Seq | ID | Seq | ID | Seq |
|---|---|---|---|---|---|---|
| 4CTLAPMP17C5 | 1053 | RFAISRDNAKVMVYLQMSSLKPDDTDVYYCAA | 1157 | ARGPWNARPSLLTYDY | 1261 | WGQGTQVTVSS |
| 4CTLAPMP11D1 | 1054 | RFTISRDNAKNTVSLQMNNLKPEDTAVYYCAA | 1158 | DTNGRWRPAIRPSDFEI | 1262 | WGQGTQVTVSS |
| 4CTLAPMP17C3 | 1055 | RFAISRDNAKNTVYLRMNNLNAEDTAVYYCAA | 1159 | RSGWGAAMRSADFRS | 1263 | WGQGTQVTVSS |
| 4CTLAPMP10A1 | 1056 | RFTISRDNAKNTVYLQMNNLKPEDTAVYYCGR | 1160 | HRSVGWRASHHLSDYDN | 1264 | WGQGTQVTVSS |
| 4CTLAPMP31A8 | 1057 | RFTISRDNAKNTVYLQMNNLKPDDTAVYYCGR | 1161 | HRSVGWRASHHLSDYDN | 1265 | WGQGTQVTVSS |
| 4CTLAPMP02H5 | 1058 | RFTISRDNAKNTVYLQMNSLKPEDTAVYYCGR | 1162 | HRSVGWRASHHLSDYDN | 1266 | WGQGTQVTVSS |
| 4CTLAPMP10G3 | 1059 | RFTISRDNAKNTVYLQMNNLKPEDTAVYYCAR | 1163 | HRSVGWRASHHLSDYDN | 1267 | WGQGTQVTVSS |
| 4CTLAPMP05F10 | 1060 | RFTISRDNAKNTVYLQMNNLKPEDTAVYYCGR | 1164 | HRSVGWRASHHLSDYDN | 1268 | WGQGTQVTVSS |
| 4CTLAPMP10B8 | 1061 | RFTISRDNAKNTVYLQMNLKPEDTAVYYCAR | 1165 | HRSVGWRASHHLSDYDN | 1269 | WGQGTQVTVSS |
| 4CTLAPMP05H11 | 1062 | RFTISRDNAKNTVCLQMNNLKPEDTAVYYCAQ | 1166 | HRSVGWRASHHLSDYDN | 1270 | WGQGTQVTVSS |
| 4CTLAPMP17H9 | 1063 | RFTISRDNAKNTVYLQMNNLKPEDTAVYYCAR | 1167 | HHSVGWRASHHLSDYDN | 1271 | WGQGTQVTVSS |
| 4CTLAPMP2G9 | 1064 | RFTISRDSAKNTVYLQMNNLKPEDTAVYYCAR | 1168 | ARSVGWRASHHLSDYDN | 1272 | WGQGTQVTVSS |
| 4CTLAPMP10H5 | 1065 | RFTISRGNAKNTVYLQMNNLKPEDTAVYYCAR | 1169 | DRSVGWRASHHLSDYGN | 1273 | WGQGTQVTVSS |
| 4CTLAPMP10B5 | 1066 | RFTISRDNAKNTVYLQMNNLKPEDTAVYYCAR | 1170 | DRSVGWRASHHLSDFDT | 1274 | WGQGTQVTVSS |
| 4CTLAPMP02A2 | 1067 | RFAISRDNANDTVYLQMNSLKPEDTAIYYCAA | 1171 | GLTGWAVIPSRTLTT | 1275 | WGQGTQVTVSS |
| 4CTLAPMP02B8 | 1068 | RFAISRBNANDTVYLQMNSLKPEDTAIYYCAA | 1172 | GLTGWAVIPSRTLTT | 1276 | WGQGTQVTVSS |
| 4CTLAPMP02A5 | 1069 | RFAISRDNAKNTVYLQMNSLKPEDTAIYYCAA | 1173 | GLTSWALIPSRTLTT | 1277 | WGQGTQVTVSS |
| 4CTLAPMP02B11 | 1070 | RFAISRDNAKNTVYLQMNSLKPEDTAIYYCAA | 1174 | GLTSWALIPSRTLTT | 1278 | WGQGTQVTVSS |

TABLE A-1g-continued

Preferred combinations of CDR sequences, preferred combinations of framework sequences, and preferred combinations of framework and CDR sequences of Nanobodies against CTLA4. ("ID" refers to the SEQ ID NO in the attached sequence listing)

| | | | | | | |
|---|---|---|---|---|---|---|
| 4CTLAPM P09C1 | 1071 | RFAISRDNAKNTV YLQMNSLKPEDT AIYYCAA | 1175 | GLTSWALIPS RTLTT | 1279 | WGQGTQVTVSS |
| 4CTLAPM P05C5 | 1072 | RFTISGDNAKNTV DLQMNSLNVEDM AVYYCAA | 1176 | DVISGRWYG GAFTPSRFDY | 1280 | WGQGTQVTVSS |
| 4CTLAPM P12B2 | 1073 | RFTISRDNAKNTV DLQMNSLNTEDM AVYYCAA | 1177 | DVISGRWYA GAFTPSRFDY | 1281 | WGQGTQVTVSS |
| 4CTLAPM P17B5 | 1074 | RFSMSRDNAKKM VDLQMNSLKPED TAVYYCAA | 1178 | KGGRWGPR NDDRYDY | 1282 | WGQGTQVTVSS |
| 4CTLAPM P02B10 | 1075 | RFTISRDNAKNTV YLQMNSLKPEDT ALYYCAR | 1179 | NRRAWSLSV HTTREYDD | 1283 | WGQGTQVTVSS |
| 4CTLAPM P02C9 | 1076 | RFTISRDNAKNTV YLQMNSLKPVDT ALYYCAR | 1180 | NRRAWSLSV HTTREYDD | 1284 | WGQGTQVTVSS |
| 4CTLAPM P04G10 | 1077 | RFTISRDNAKNTV YLQMNSLKPEDT ALYYCAR | 1181 | NRRAWSLSV HTTREYDD | 1285 | WGQGTQVTVSS |
| 4CTLAPM P17B6 | 1078 | RFTISRDNAKNTV YLQMNSLKPEDA ARYYCAA | 1182 | DRRAWSARP DMGNYY | 1286 | WGQGTQVTVSS |
| 4CTLAPM P06C10 | 1079 | rFTISrdnakntvwlqm nslkledtavyycaa | 1183 | DPSGWGLR QHSENEYPY | 1287 | wglgtqVTVSS |

Thus, in the Nanobodies of the invention, at least one of the CDR1, CDR2 and CDR3 sequences present is suitably chosen from the group consisting of the CDR1, CDR2 and CDR3 sequences, respectively, listed in Table A-1g; or from the group of CDR1, CDR2 and CDR3 sequences, respectively, that have at least 80%, preferably at least 90%, more preferably at least 95%, even more preferably at least 99% "sequence identity" (as defined herein) with at least one of the CDR1, CDR2 and CDR3 sequences, respectively, listed in Table A-1g; and/or from the group consisting of the CDR1, CDR2 and CDR3 sequences, respectively, that have 3, 2 or only 1 "amino acid difference(s)" (as defined herein) with at least one of the CDR1, CDR2 and CDR3 sequences, respectively, listed in Table A-1g.

In this context, by "suitably chosen" is meant that, as applicable, a CDR1 sequence is chosen from suitable CDR1 sequences (i.e. as defined herein), a CDR2 sequence is chosen from suitable CDR2 sequences (i.e. as defined herein), and a CDR3 sequence is chosen from suitable CDR3 sequence (i.e. as defined herein), respectively. More in particular, the CDR sequences are preferably chosen such that the Nanobodies of the invention bind to CTLA4 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In particular, in the Nanobodies of the invention, at least the CDR3 sequence present is suitably chosen from the group consisting of the CDR3 sequences listed in Table A-1g or from the group of CDR3 sequences that have at least 80%, preferably at least 90%, more preferably at least 95%, even more preferably at least 99% sequence identity with at least one of the CDR3 sequences listed in Table A-1g; and/or from the group consisting of the CDR3 sequences that have 3, 2 or only 1 amino acid difference(s) with at least one of the CDR3 sequences listed in Table A-1g.

Preferably, in the Nanobodies of the invention, at least two of the CDR1, CDR2 and CDR3 sequences present are suitably chosen from the group consisting of the CDR1, CDR2 and CDR3 sequences, respectively, listed in Table A-1g or from the group consisting of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table A-1g; and/or from the group consisting of the CDR1, CDR2 and CDR3 sequences, respectively, that have 3, 2 or only 1 "amino acid difference(s)" with at least one of the CDR1, CDR2 and CDR3 sequences, respectively, listed in Table A-1g.

In particular, in the Nanobodies of the invention, at least the CDR3 sequence present is suitably chosen from the group consisting of the CDR3 sequences listed in Table A-1g or from the group of CDR3 sequences that have at least 80%, preferably at least 90%, more preferably at least 95%, even more preferably at least 99% sequence identity with at least one of the CDR3 sequences listed in Table A-1g, respectively; and at least one of the CDR1 and CDR2 sequences present is suitably chosen from the group consisting of the CDR1 and CDR2 sequences, respectively, listed in Table A-1g or from the group of CDR1 and CDR2 sequences, respectively, that have at least 80%, preferably at least 90%, more preferably at least 95%, even more preferably at least 99% sequence identity with at least one of the CDR1 and CDR2 sequences, respectively, listed in Table A-1g; and/or from the group consisting of the CDR1 and CDR2 sequences, respectively, that have 3, 2 or only 1 amino acid difference(s) with at least one of the CDR1 and CDR2 sequences, respectively, listed in Table A-1g.

Most preferably, in the Nanobodies of the invention, all three CDR1, CDR2 and CDR3 sequences present are suitably chosen from the group consisting of the CDR1, CDR2 and CDR3 sequences, respectively, listed in Table A-1g or from the group of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table A-1g; and/or from the group consisting of the CDR1, CDR2 and CDR3 sequences, respectively, that have 3, 2 or only 1 amino acid difference(s) with at least one of the CDR1, CDR2 and CDR3 sequences, respectively, listed in Table A-1g.

Even more preferably, in the Nanobodies of the invention, at least one of the CDR1, CDR2 and CDR3 sequences present is suitably chosen from the group consisting of the CDR1, CDR2 and CDR3 sequences, respectively, listed in Table A-1g. Preferably, in this aspect, at least one or preferably both of the other two CDR sequences present are suitably chosen from CDR sequences that have at least 80%, preferably at least 90%, more preferably at least 95%, even more preferably at least 99% sequence identity with at least one of the corresponding CDR sequences, respectively, listed in Table A-1g; and/or from the group consisting of the CDR sequences that have 3, 2 or only 1 amino acid difference(s) with at least one of the corresponding sequences, respectively, listed in Table A-1g.

In particular, in the Nanobodies of the invention, at least the CDR3 sequence present is suitably chosen from the group consisting of the CDR3 listed in Table A-1g. Preferably, in this aspect, at least one and preferably both of the CDR1 and CDR2 sequences present are suitably chosen from the groups of CDR1 and CDR2 sequences, respectively, that have at least 80%, preferably at least 90%, more preferably at least 95%, even more preferably at least 99% sequence identity with the CDR1 and CDR2 sequences, respectively, listed in Table A-1g; and/or from the group consisting of the CDR1 and CDR2 sequences, respectively, that have 3, 2 or only 1 amino acid difference(s) with at least one of the CDR1 and CDR2 sequences, respectively, listed in Table A-1g.

Even more preferably, in the Nanobodies of the invention, at least two of the CDR1, CDR2 and CDR3 sequences present are suitably chosen from the group consisting of the CDR1, CDR2 and CDR3 sequences, respectively, listed in Table A-1g. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table A-1g; and/or from the group consisting of CDR sequences that have 3, 2 or only 1 amino acid difference(s) with at least one of the corresponding sequences listed in Table A-1g.

In particular, in the Nanobodies of the invention, at least the CDR3 sequence is suitably chosen from the group consisting of the CDR3 sequences listed in Table A-1g, and either the CDR1 sequence or the CDR2 sequence is suitably chosen from the group consisting of the CDR1 and CDR2 sequences, respectively, listed in Table A-1g. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table A-1g; and/or from the group consisting of CDR sequences that have 3, 2 or only 1 amino acid difference(s) with the corresponding CDR sequences listed in Table A-1g.

Even more preferably, in the Nanobodies of the invention, all three CDR1, CDR2 and CDR3 sequences present are suitably chosen from the group consisting of the CDR1, CDR2 and CDR3 sequences, respectively, listed in Table A-1g.

Also, generally, the combinations of CDR's listed in Table A-1g (i.e. those mentioned on the same line in Table A-1g) are preferred. Thus, it is generally preferred that, when a CDR in a Nanobody of the invention is a CDR sequence mentioned in Table A-1g or is suitably chosen from the group of CDR sequences that have at least 80%, preferably at least 90%, more preferably at least 95%, even more preferably at least 99% sequence identity with a CDR sequence listed in Table A-1g; and/or from the group consisting of CDR sequences that have 3, 2 or only 1 amino acid difference(s) with a CDR sequence listed in Table A-1g, that at least one and preferably both of the other CDR's are suitably chosen from the CDR sequences that belong to the same combination in Table A-1g (i.e. mentioned on the same line in Table A-1g) or are suitably chosen from the group of CDR sequences that have at least 80%, preferably at least 90%, more preferably at least 95%, even more preferably at least 99% sequence identity with the CDR sequence(s) belonging to the same combination and/or from the group consisting of CDR sequences that have 3, 2 or only 1 amino acid difference(s) with the CDR sequence(s) belonging to the same combination. The other preferences indicated in the above paragraphs also apply to the combinations of CDR's mentioned in Table A-1g.

Thus, by means of non-limiting examples, a Nanobody of the invention can for example comprise a CDR1 sequence that has more than 80% sequence identity with one of the CDR1 sequences mentioned in Table A-1g, a CDR2 sequence that has 3, 2 or 1 amino acid difference with one of the CDR2 sequences mentioned in Table A-1g (but belonging to a different combination), and a CDR3 sequence.

Some preferred Nanobodies of the invention may for example comprise: (1) a CDR1 sequence that has more than 80% sequence identity with one of the CDR1 sequences mentioned in Table A-1g; a CDR2 sequence that has 3, 2 or 1 amino acid difference with one of the CDR2 sequences mentioned in Table A-1g (but belonging to a different combination); and a CDR3 sequence that has more than 80% sequence identity with one of the CDR3 sequences mentioned in Table A-1g (but belonging to a different combination); or (2) a CDR1 sequence that has more than 80% sequence identity with one of the CDR1 sequences mentioned in Table A-1g; a CDR2 sequence, and one of the CDR3 sequences listed in Table A-1g; or (3) a CDR1 sequence; a CDR2 sequence that has more than 80% sequence identity with one of the CDR2 sequence listed in Table A-1g; and a CDR3 sequence that has 3, 2 or 1 amino acid differences with the CDR3 sequence mentioned in Table A-1g that belongs to the same combination as the CDR2 sequence.

Some particularly preferred Nanobodies of the invention may for example comprise: (1) a CDR1 sequence that has more than 80% sequence identity with one of the CDR1 sequences mentioned in Table A-1g; a CDR2 sequence that has 3, 2 or 1 amino acid difference with the CDR2 sequence mentioned in Table A-1g that belongs to the same combination; and a CDR3 sequence that has more than 80% sequence identity with the CDR3 sequence mentioned in Table A-1g that belongs to the same combination; (2) a CDR1 sequence; a CDR 2 listed in Table A-1g and a CDR3 sequence listed in Table A-1g (in which the CDR2 sequence and CDR3 sequence may belong to different combinations).

Some even more preferred Nanobodies of the invention may for example comprise: (1) a CDR1 sequence that has more than 80% sequence identity with one of the CDR1 sequences mentioned in Table A-1g; the CDR2 sequence listed in Table A-1g that belongs to the same combination; and a CDR3 sequence mentioned in Table A-1g that belongs to a different combination; or (2) a CDR1 sequence mentioned in Table A-1g; a CDR2 sequence that has 3, 2 or 1 amino acid differences with the CDR2 sequence mentioned in Table A-1g that belongs to the same combination; and a CDR3 sequence that has more than 80% sequence identity with the CDR3 sequence listed in Table A-1g that belongs to the same or a different combination.

Particularly preferred Nanobodies of the invention may for example comprise a CDR1 sequence mentioned in Table A-1g, a CDR2 sequence that has more than 80% sequence identity with the CDR2 sequence mentioned in Table A-1g that belongs to the same combination; and the CDR3 sequence mentioned in Table A-1g that belongs to the same combination.

In the most preferred Nanobodies of the invention, the CDR1, CDR2 and CDR3 sequences present are suitably chosen from one of the combinations of CDR1, CDR2 and CDR3 sequences, respectively, listed in Table A-1g.

According to another preferred, but non-limiting aspect of the invention (a) CDR1 has a length of between 1 and 12 amino acid residues, and usually between 2 and 9 amino acid residues, such as 5, 6 or 7 amino acid residues; and/or (b) CDR2 has a length of between 13 and 24 amino acid residues, and usually between 15 and 21 amino acid residues, such as 16 and 17 amino acid residues; and/or (c) CDR3 has a length of between 2 and 35 amino acid residues, and usually between 3 and 30 amino acid residues, such as between 6 and 23 amino acid residues.

In another preferred, but non-limiting aspect, the invention relates to a Nanobody in which the CDR sequences (as defined herein) have more than 80%, preferably more than 90%, more preferably more than 95%, such as 99% or more sequence identity (as defined herein) with the CDR sequences of at least one of the amino acid sequences of SEQ ID NO's: 1288-1391.

Generally, Nanobodies with the above CDR sequences may be as further described herein, and preferably have framework sequences that are also as further described herein. Thus, for example and as mentioned herein, such Nanobodies may be naturally occurring Nanobodies (from any suitable species), naturally occurring $V_{HH}$ sequences (i.e. from a suitable species of Camelid) or synthetic or semi-synthetic amino acid sequences or Nanobodies, including but not limited to partially humanized Nanobodies or $V_{HH}$ sequences, fully humanized Nanobodies or $V_{HH}$ sequences, camelized heavy chain variable domain sequences, as well as Nanobodies that have been obtained by the techniques mentioned herein.

Thus, in one specific, but non-limiting aspect, the invention relates to a humanized Nanobody, which consists of 4 framework regions (FR1 to FR4 respectively) and 3 complementarity determining regions (CDR1 to CDR3 respectively), in which CDR1 to CDR3 are as defined herein and in which said humanized Nanobody comprises at least one humanizing substitution (as defined herein), and in particular at least one humanizing substitution in at least one of its framework sequences (as defined herein).

In another preferred, but non-limiting aspect, the invention relates to a Nanobody in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 1288-1391. This degree of amino acid identity can for example be determined by determining the degree of amino acid identity (in a manner described herein) between said Nanobody and one or more of the sequences of SEQ ID NO's: 1288-1391, in which the amino acid residues that form the framework regions are disregarded. Such Nanobodies can be as further described herein.

In another preferred, but non-limiting aspect, the invention relates to a Nanobody with an amino acid sequence that is chosen from the group consisting of SEQ ID NO's: 1288-1391 or from the group consisting of from amino acid sequences that have more than 80%, preferably more than 90%, more preferably more than 95%, such as 99% or more sequence identity (as defined herein) with at least one of the amino acid sequences of SEQ ID NO's: 1288-1391.

Another preferred, but non-limiting aspect of the invention relates to humanized variants of the Nanobodies of SEQ ID NO's: 1288-1391, that comprise, compared to the corresponding native $V_{HH}$ sequence, at least one humanizing substitution (as defined herein), and in particular at least one humanizing substitution in at least one of its framework sequences (as defined herein). Some preferred, but non-limiting examples of such humanized variants are the humanized Nanobodies of SEQ ID NO's: 1407-1418. Thus, the invention also relates to a humanized Nanobody with an amino acid sequence that is chosen from the group consisting of SEQ ID NO's: 1407-1418 or from the group consisting of from amino acid sequences that have more than 80%, preferably more than 90%, more preferably more than 95%, such as 99% or more sequence identity (as defined herein) with at least one of the amino acid sequences of SEQ ID NO's: 1407-1418 (in which amino acid sequences that are chosen from the latter group of amino acid sequences may contain a greater number or a smaller number of humanizing substitutions compared to the corresponding sequence of SEQ ID NO's: 1407-1418, as long as they retain at least one of the humanizing substitutions present in the corresponding sequence of SEQ ID NO's: 1407-1418).

The polypeptides of the invention comprise or essentially consist of at least one Nanobody of the invention. Some preferred, but non-limiting examples of polypeptides of the invention are given in SEQ ID NO's: 1392-1399.

It will be clear to the skilled person that the Nanobodies that are mentioned herein as "preferred" (or "more preferred", "even more preferred", etc.) are also preferred (or more preferred, or even more preferred, etc.) for use in the polypeptides described herein. Thus, polypeptides that comprise or essentially consist of one or more "preferred" Nanobodies of the invention will generally be preferred, and polypeptides that comprise or essentially consist of one or more "more preferred" Nanobodies of the invention will generally be more preferred, etc.

Generally, proteins or polypeptides that comprise or essentially consist of a single Nanobody (such as a single Nanobody of the invention) will be referred to herein as "monovalent" proteins or polypeptides or as "monovalent constructs".

Proteins and polypeptides that comprise or essentially consist of two or more Nanobodies (such as at least two Nanobodies of the invention or at least one Nanobody of the invention and at least one other Nanobody) will be referred to herein as "multivalent" proteins or polypeptides or as "multivalent constructs", and these may provide certain advantages compared to the corresponding monovalent Nanobodies of the invention. Some non-limiting examples of such multivalent constructs will become clear from the further description herein; some preferred, but non-limiting examples of such multivalent Nanobody constructs against CTLA4 are the constructs of SEQ ID NO's: 1392-1399.

In one, non-limiting, aspect of the invention, a monovalent construct may be advantageous and/or preferred over corresponding multivalent constructs. A monovalent (Fab) anti-CD80 monoclonal antibody, for example, proved to be much more efficient for improving EAE compared to the corresponding bivalent monoclonal antibody (Podojil et al., see supra). Accordingly, in one preferred aspect, the invention relates to a monovalent construct comprising only one Nanobody of the invention or else, to a multivalent construct comprising one Nanobody of the invention and one or more other binding units (i.e. against one or more other targets than the one or more APC target or the one or more T-cell target) as further described herein.

According to another specific, but non-limiting aspect, a polypeptide of the invention comprises or essentially consists of at least two Nanobodies of the invention, such as two or three Nanobodies of the invention. As further described herein, such multivalent constructs can provide certain advantages compared to a protein or polypeptide comprising or essentially consisting of a single Nanobody of the invention, such as a much improved avidity for the APC target or T-cell target. Such multivalent constructs will be clear to the skilled person based on the disclosure herein.

According to another specific, but non-limiting aspect, a polypeptide of the invention comprises or essentially consists of at least one Nanobody of the invention and at least one other binding unit (i.e. directed against another epitope, antigen, target, protein or polypeptide), which is preferably also a Nanobody. Such proteins or polypeptides are also referred to herein as "multispecific" proteins or polypeptides or as "multispecific constructs", and these may provide certain advantages compared to the corresponding monovalent Nanobodies of the invention (as will become clear from the further discussion herein of some preferred, but-nonlimiting multispecific constructs). Such multispecific constructs will be clear to the skilled person based on the disclosure herein; some preferred, but non-limiting examples of such multispecific Nanobody constructs are the constructs of SEQ ID NO's: 1392-1395.

According to yet another specific, but non-limiting aspect, a polypeptide of the invention comprises or essentially consists of at least one Nanobody of the invention, optionally one or more further Nanobodies, and at least one other amino acid sequence (such as a protein or polypeptide) that confers at least one desired property to the Nanobody of the invention and/or to the resulting fusion protein. Again, such fusion proteins may provide certain advantages compared to the corresponding monovalent Nanobodies of the invention. Some non-limiting examples of such amino acid sequences and of such fusion constructs will become clear from the further description herein.

It is also possible to combine two or more of the above aspects, for example to provide a trivalent bispecific construct comprising two Nanobodies of the invention and one other Nanobody, and optionally one or more other amino acid sequences. Further non-limiting examples of such constructs, as well as some constructs that are particularly preferred within the context of the present invention, will become clear from the further description herein.

In the above constructs, the one or more Nanobodies and/or other amino acid sequences may be directly linked to each other and/or suitably linked to each other via one or more linker sequences. Some suitable but non-limiting examples of such linkers will become clear from the further description herein.

In one specific aspect of the invention, a Nanobody of the invention or a compound, construct or polypeptide of the invention comprising at least one Nanobody of the invention may have an increased half-life, compared to the corresponding amino acid sequence of the invention. Some preferred, but non-limiting examples of such Nanobodies, compounds and polypeptides will become clear to the skilled person based on the further disclosure herein, and for example comprise Nanobodies sequences or polypeptides of the invention that have been chemically modified to increase the half-life thereof (for example, by means of pegylation); amino acid sequences of the invention that comprise at least one additional binding site for binding to a serum protein (such as serum albumin); or polypeptides of the invention that comprise at least one Nanobody of the invention that is linked to at least one moiety (and in particular at least one amino acid sequence) that increases the half-life of the Nanobody of the invention. Examples of polypeptides of the invention that comprise such half-life extending moieties or amino acid sequences will become clear to the skilled person based on the further disclosure herein; and for example include, without limitation, polypeptides in which the one or more Nanobodies of the invention are suitable linked to one or more serum proteins or fragments thereof (such as serum albumin or suitable fragments thereof) or to one or more binding units that can bind to serum proteins (such as, for example, Nanobodies or (single) domain antibodies that can bind to serum proteins such as serum albumin, serum immunoglobulins such as IgG, or transferrine); polypeptides in which a Nanobody of the invention is linked to an Fc portion (such as a human Fc) or a suitable part or fragment thereof; or polypeptides in which the one or more Nanobodies of the invention are suitable linked to one or more small proteins or peptides that can bind to serum proteins (such as, without limitation, the proteins and peptides described in WO 91/01743, WO 01/45746, WO 02/076489 and to the US provisional application of Ablynx N.V. entitled "Peptides capable of binding to serum proteins" of Ablynx N.V. filed on Dec. 5, 2006 (see also PCT/EP/2007/063348).

Again, as will be clear to the skilled person, such Nanobodies, compounds, constructs or polypeptides may contain one or more additional groups, residues, moieties or binding units, such as one or more further amino acid sequences and in particular one or more additional Nanobodies (i.e. not directed against the APC target or T-cell target), so as to provide a tri- of multispecific Nanobody construct.

Generally, the Nanobodies of the invention (or compounds, constructs or polypeptides comprising the same) with increased half-life preferably have a half-life that is at least 1.5 times, preferably at least 2 times, such as at least 5 times, for example at least 10 times or more than 20 times, greater than the half-life of the corresponding amino acid sequence of the invention per se. For example, the Nanobodies, compounds, constructs or polypeptides of the invention with increased half-life may have a half-life that is increased with more than 1 hours, preferably more than 2 hours, more preferably more than 6 hours, such as more than 12 hours, or even more than 24, 48 or 72 hours, compared to the corresponding amino acid sequence of the invention per se.

In a preferred, but non-limiting aspect of the invention, such Nanobodies, compound, constructs or polypeptides of the invention exhibit a serum half-life in human of at least about 12 hours, preferably at least 24 hours, more preferably at least 48 hours, even more preferably at least 72 hours or more. For example, compounds or polypeptides of the invention may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

In another one aspect of the invention, a polypeptide of the invention comprises one or more (such as two or preferably one) Nanobodies of the invention linked (optionally via one or more suitable linker sequences) to one or more (such as two and preferably one) amino acid sequences that allow the resulting polypeptide of the invention to cross the blood brain barrier. In particular, said one or more amino acid sequences that allow the resulting polypeptides of the invention to cross the blood brain barrier may be one or more (such as two and preferably one) Nanobodies, such as the Nanobodies described in WO 02/057445, of which FC44 (SEQ ID NO: 189 of WO 06/040153) and FC5 (SEQ ID NO: 190 of WO 06/040154) are preferred examples.

In particular, polypeptides comprising one or more Nanobodies of the invention are preferably such that they:

bind to the APC target or T-cell target with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to the APC target or T-cell target with a $k_{on}$-rate of between $10^2$ $M^{-1}$ $s^{-1}$ to about $10^7$ $M^{-1}$ $s^{-1}$, preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$;

and/or such that they:

bind to the APC target or T-cell target with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, a polypeptide that contains only one amino acid sequence of the invention is preferably such that it will bind to the APC target or T-cell target with an affinity less than 500 nM, preferably less than 200 nM, more preferably less than 10 nM, such as less than 500 pM. In this respect, it will be clear to the skilled person that a polypeptide that contains two or more Nanobodies of the invention may bind to the APC target or T-cell target with an increased avidity, compared to a polypeptide that contains only one amino acid sequence of the invention.

Some preferred $IC_{50}$ values for binding of the amino acid sequences or polypeptides of the invention to the APC target or T-cell target will become clear from the further description and examples herein.

Other polypeptides according to this preferred aspect of the invention may for example be chosen from the group consisting of amino acid sequences that have more than 80%, preferably more than 90%, more preferably more than 95%, such as 99% or more "sequence identity" (as defined herein) with one or more of the amino acid sequences of SEQ ID NO's: 1392-1399, in which the Nanobodies comprised within said amino acid sequences are preferably as further defined herein.

Another aspect of this invention relates to a nucleic acid that encodes an amino acid sequence of the invention (such as a Nanobody of the invention) or a polypeptide of the invention comprising the same. Again, as generally described herein for the nucleic acids of the invention, such a nucleic acid may be in the form of a genetic construct, as defined herein.

In another aspect, the invention relates to host or host cell that expresses or that is capable of expressing an amino acid sequence (such as a Nanobody) of the invention and/or a polypeptide of the invention comprising the same; and/or that contains a nucleic acid of the invention. Some preferred but non-limiting examples of such hosts or host cells will become clear from the further description herein.

Another aspect of the invention relates to a product or composition containing or comprising at least one amino acid of the invention, at least one polypeptide of the invention and/or at least one nucleic acid of the invention, and optionally one or more further components of such compositions known per se, i.e. depending on the intended use of the composition. Such a product or composition may for example be a pharmaceutical composition (as described herein), a veterinary composition or a product or composition for diagnostic use (as also described herein). Some preferred but non-limiting examples of such products or compositions will become clear from the further description herein.

The invention further relates to methods for preparing or generating the amino acids, compounds, constructs, polypeptides, nucleic acids, host cells, products and compositions described herein. Some preferred but non-limiting examples of such methods will become clear from the further description herein.

The invention further relates to applications and uses of the amino acid sequences, compounds, constructs, polypeptides, nucleic acids, host cells, products and compositions described herein, as well as to methods for the prevention and/or treatment for diseases and disorders associated with an APC target or a T-cell target. Some preferred but non-limiting applications and uses will become clear from the further description herein.

Other aspects, embodiments, advantages and applications of the invention will also become clear from the further description hereinbelow.

Generally, it should be noted that the term Nanobody as used herein in its broadest sense is not limited to a specific biological source or to a specific method of preparation. For example, as will be discussed in more detail below, the Nanobodies of the invention can generally be obtained: (1) by isolating the $V_{HH}$ domain of a naturally occurring heavy chain antibody; (2) by expression of a nucleotide sequence encoding a naturally occurring $V_{HH}$ domain; (3) by "humanization" (as described herein) of a naturally occurring $V_{HH}$ domain or by expression of a nucleic acid encoding a such humanized $V_{HH}$ domain; (4) by "camelization" (as described herein) of a naturally occurring $V_H$ domain from any animal species, and in particular a from species of mammal, such as from a human being, or by expression of a nucleic acid encoding such a camelized $V_H$ domain; (5) by "camelisation" of a "domain antibody" or "Dab" as described by Ward et al (supra), or by expression of a nucleic acid encoding such a camelized $V_H$ domain; (6) by using synthetic or semi-synthetic techniques for preparing proteins, polypeptides or other amino acid sequences known per se; (7) by preparing a nucleic acid encoding a Nanobody using techniques for nucleic acid synthesis known per se, followed by expression of the nucleic acid thus obtained; and/or (8) by any combination of one or more of the foregoing. Suitable methods and techniques for performing the foregoing will be clear to the skilled person based on the disclosure herein and for example include the methods and techniques described in more detail herein.

One preferred class of Nanobodies corresponds to the $V_{HH}$ domains of naturally occurring heavy chain antibodies directed against an APC target or T-cell target. As further described herein, such $V_{HH}$ sequences can generally be generated or obtained by suitably immunizing a species of Camelid with an APC target or T-cell target (i.e. so as to raise an immune response and/or heavy chain antibodies directed against the APC target or T-cell target), by obtaining a suitable biological sample from said Camelid (such as a blood sample, serum sample or sample of B-cells), and by generating $V_{HH}$ sequences directed against the APC target or T-cell target, starting from said sample, using any suitable technique known per se. Such techniques will be clear to the skilled person and/or are further described herein.

Alternatively, such naturally occurring $V_{HH}$ domains against an APC target or T-cell target, can be obtained from naïve libraries of Camelid $V_{HH}$ sequences, for example by screening such a library using the APC target or T-cell target, or at least one part, fragment, antigenic determinant or epitope thereof using one or more screening techniques known per se. Such libraries and techniques are for example described in WO 99/37681, WO 01/90190, WO 03/025020 and WO 03/035694. Alternatively, improved synthetic or semi-synthetic libraries derived from naïve $V_{HH}$ libraries may be used, such as $V_{HH}$ libraries obtained from naïve $V_{HH}$ libraries by techniques such as random mutagenesis and/or CDR shuffling, as for example described in WO 00/43507.

Thus, in another aspect, the invention relates to a method for generating Nanobodies, that are directed against an APC target or a T-cell target. In one aspect, said method at least comprises the steps of:
a) providing a set, collection or library of Nanobody sequences; and
b) screening said set, collection or library of Nanobody sequences for Nanobody sequences that can bind to and/or have affinity for an APC target or T-cell target;
and
c) isolating the amino acid sequence(s) that can bind to and/or have affinity for the APC target or T-cell target.

In such a method, the set, collection or library of Nanobody sequences may be a naïve set, collection or library of Nanobody sequences; a synthetic or semi-synthetic set, collection or library of Nanobody sequences; and/or a set, collection or library of Nanobody sequences that have been subjected to affinity maturation.

In a preferred aspect of this method, the set, collection or library of Nanobody sequences may be an immune set, collection or library of Nanobody sequences, and in particular an immune set, collection or library of $V_{HH}$ sequences, that have been derived from a species of Camelid that has been suitably immunized with the APC target or T-cell target or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

In the above methods, the set, collection or library of Nanobody or $V_{HH}$ sequences may be displayed on a phage, phagemid, ribosome or suitable micro-organism (such as yeast), such as to facilitate screening. Suitable methods, techniques and host organisms for displaying and screening (a set, collection or library of) Nanobody sequences will be clear to the person skilled in the art, for example on the basis of the further disclosure herein. Reference is also made to WO 03/054016 and to the review by Hoogenboom in Nature Biotechnology, 23, 9, 1105-1116 (2005).

In another aspect, the method for generating Nanobody sequences comprises at least the steps of:
a) providing a collection or sample of cells derived from a species of Camelid that express immunoglobulin sequences;
b) screening said collection or sample of cells for (i) cells that express an immunoglobulin sequence that can bind to and/or have affinity for an APC target or T-cell target; and (ii) cells that express heavy chain antibodies, in which sub-steps (i) and (ii) can be performed essentially as a single screening step or in any suitable order as two separate screening steps, so as to provide at least one cell that expresses a heavy chain antibody that can bind to and/or has affinity for an APC target or T-cell target;
and
c) either (i) isolating from said cell the $V_{HH}$ sequence present in said heavy chain antibody; or (ii) isolating from said cell a nucleic acid sequence that encodes the $V_{HH}$ sequence present in said heavy chain antibody, followed by expressing said $V_{HH}$ domain.

In the method according to this aspect, the collection or sample of cells may for example be a collection or sample of B-cells. Also, in this method, the sample of cells may be derived from a Camelid that has been suitably immunized with the APC target or T-cell target or a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The above method may be performed in any suitable manner, as will be clear to the skilled person. Reference is for example made to EP 0 542 810, WO 05/19824, WO 04/051268 and WO 04/106377. The screening of step b) is preferably performed using a flow cytometry technique such as FACS. For this, reference is for example made to Lieby et al., Blood, Vol. 97, No. 12, 3820. Particular reference is made to the so-called "Nanoclone™" technique described in International application WO 06/079372 by Ablynx N.V.

In another aspect, the method for generating an amino acid sequence directed against an APC target or T-cell target may comprise at least the steps of:
a) providing a set, collection or library of nucleic acid sequences encoding heavy chain antibodies or Nanobody sequences;
b) screening said set, collection or library of nucleic acid sequences for nucleic acid sequences that encode a heavy chain antibody or a Nanobody sequence that can bind to and/or has affinity for an APC target or T-cell target;
and
c) isolating said nucleic acid sequence, followed by expressing the $V_{HH}$ sequence present in said heavy chain antibody or by expressing said Nanobody sequence, respectively.

In such a method, the set, collection or library of nucleic acid sequences encoding heavy chain antibodies or Nanobody sequences may for example be a set, collection or library of nucleic acid sequences encoding a naïve set, collection or library of heavy chain antibodies or $V_{HH}$ sequences; a set, collection or library of nucleic acid sequences encoding a synthetic or semi-synthetic set, collection or library of Nanobody sequences; and/or a set, collection or library of nucleic acid sequences encoding a set, collection or library of Nanobody sequences that have been subjected to affinity maturation.

In a preferred aspect of this method, the set, collection or library of amino acid sequences may be an immune set, collection or library of nucleic acid sequences encoding heavy chain antibodies or $V_{HH}$ sequences derived from a Camelid that has been suitably immunized with the APC target or T-cell target or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

In the above methods, the set, collection or library of nucleotide sequences may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to WO 03/054016 and to the review by Hoogenboom in Nature Biotechnology, 23, 9, 1105-1116 (2005).

As will be clear to the skilled person, the screening step of the methods described herein can also be performed as a selection step. Accordingly the term "screening" as used in the present description can comprise selection, screening or any suitable combination of selection and/or screening techniques. Also, when a set, collection or library of sequences is used, it may contain any suitable number of sequences, such as 1, 2, 3 or about 5, 10, 50, 100, 500, 1000, 5000, $10^4$, $10^5$, $10^6$, $10^7$, $10^8$ or more sequences.

Also, one or more or all of the sequences in the above set, collection or library of amino acid sequences may be obtained or defined by rational, or semi-empirical approaches such as computer modelling techniques or biostatics or datamining techniques.

Furthermore, such a set, collection or library can comprise one, two or more sequences that are variants from one another (e.g. with designed point mutations or with randomized positions), compromise multiple sequences derived from a diverse set of naturally diversified sequences (e.g. an immune library)), or any other source of diverse sequences (as described for example in Hoogenboom et al, Nat Biotechnol 23:1105, 2005 and Binz et al, Nat Biotechnol 2005, 23:1247). Such set, collection or library of sequences can be displayed on the surface of a phage particle, a ribosome, a bacterium, a yeast cell, a mammalian cell, and linked to the nucleotide sequence encoding the amino acid sequence within these carriers. This makes such set, collection or library amenable to selection procedures to isolate the desired amino acid sequences of the invention. More generally, when a sequence is displayed on a suitable host or host cell, it is also possible (and customary) to first isolate from said host or host cell a nucleotide sequence that encodes the desired sequence, and then to obtain the desired sequence by suitably expressing said nucleotide sequence in a suitable host organism. Again, this can be performed in any suitable manner known per se, as will be clear to the skilled person.

Yet another technique for obtaining $V_{HH}$ sequences or Nanobody sequences directed against an APC target or T-cell target involves suitably immunizing a transgenic mammal that is capable of expressing heavy chain antibodies (i.e. so as to raise an immune response and/or heavy chain antibodies directed against the APC target or T-cell target), obtaining a suitable biological sample from said transgenic mammal that contains (nucleic acid sequences encoding) said $V_{HH}$ sequences or Nanobody sequences (such as a blood sample, serum sample or sample of B-cells), and then generating $V_{HH}$ sequences directed against the APC target or T-cell target, starting from said sample, using any suitable technique known per se (such as any of the methods described herein or a hybridoma technique). For example, for this purpose, the heavy chain antibody-expressing mice and the further methods and techniques described in WO 02/085945, WO 04/049794 and WO 06/008548 and Janssens et al., Proc. Natl. Acad. Sci. USA. 2006 Oct. 10; 103(41):15130-5 can be used. For example, such heavy chain antibody expressing mice can express heavy chain antibodies with any suitable (single) variable domain, such as (single) variable domains from natural sources (e.g. human (single) variable domains, Camelid (single) variable domains or shark (single) variable domains), as well as for example synthetic or semi-synthetic (single) variable domains.

The invention also relates to the $V_{HH}$ sequences or Nanobody sequences that are obtained by the above methods, or alternatively by a method that comprises the one of the above methods and in addition at least the steps of determining the nucleotide sequence or amino acid sequence of said $V_{HH}$ sequence or Nanobody sequence; and of expressing or synthesizing said $V_{HH}$ sequence or Nanobody sequence in a manner known per se, such as by expression in a suitable host cell or host organism or by chemical synthesis.

As mentioned herein, a particularly preferred class of Nanobodies of the invention comprises Nanobodies with an amino acid sequence that corresponds to the amino acid sequence of a naturally occurring $V_{HH}$ domain, but that has been "humanized", i.e. by replacing one or more amino acid residues in the amino acid sequence of said naturally occurring $V_{HH}$ sequence (and in particular in the framework sequences) by one or more of the amino acid residues that occur at the corresponding position(s) in a $V_H$ domain from a conventional 4-chain antibody from a human being (e.g. indicated above). This can be performed in a manner known per se, which will be clear to the skilled person, for example on the basis of the further description herein and the prior art on humanization referred to herein. Again, it should be noted that such humanized Nanobodies of the invention can be obtained in any suitable manner known per se (i.e. as indicated under points (1)-(8) above) and thus are not strictly limited to polypeptides that have been obtained using a polypeptide that comprises a naturally occurring $V_{HH}$ domain as a starting material.

Another particularly preferred class of Nanobodies of the invention comprises Nanobodies with an amino acid sequence that corresponds to the amino acid sequence of a naturally occurring $V_H$ domain, but that has been "camelized", i.e. by replacing one or more amino acid residues in the amino acid sequence of a naturally occurring $V_H$ domain from a conventional 4-chain antibody by one or more of the amino acid residues that occur at the corresponding position(s) in a $V_{HH}$ domain of a heavy chain antibody. This can be performed in a manner known per se, which will be clear to the skilled person, for example on the basis of the further description herein. Such "camelizing" substitutions are preferably inserted at amino acid positions that form and/or are present at the $V_H$-$V_L$ interface, and/or at the so-called Camelidae hallmark residues, as defined herein (see for example WO 94/04678 and Davies and Riechmann (1994 and 1996), supra). Preferably, the $V_H$ sequence that is used as a starting material or starting point for generating or designing the camelized Nanobody is preferably a $V_H$ sequence from a mammal, more preferably the V$_H$ sequence of a human being, such as a V$_H$3 sequence. However, it should be noted that such camelized Nanobodies of the invention can be obtained in any suitable manner known per se (i.e. as indicated under points (1)-(8) above) and thus are not strictly limited to polypeptides that have been obtained using a polypeptide that comprises a naturally occurring V$_H$ domain as a starting material.

For example, again as further described herein, both "humanization" and "camelization" can be performed by providing a nucleotide sequence that encodes a naturally occurring V$_{HH}$ domain or V$_H$ domain, respectively, and then changing, in a manner known per se, one or more codons in said nucleotide sequence in such a way that the new nucleotide sequence encodes a "humanized" or "camelized" Nanobody of the invention, respectively. This nucleic acid can then be expressed in a manner known per se, so as to provide the desired Nanobody of the invention. Alternatively, based on the amino acid sequence of a naturally occurring V$_{HH}$ domain or V$_H$ domain, respectively, the amino acid sequence of the desired humanized or camelized Nanobody of the invention, respectively, can be designed and then synthesized de novo using techniques for peptide synthesis known per se. Also, based on the amino acid sequence or nucleotide sequence of a naturally occurring V$_{HH}$ domain or V$_H$ domain, respectively, a nucleotide sequence encoding the desired humanized or camelized Nanobody of the invention, respectively, can be designed and then synthesized de novo using techniques for nucleic acid synthesis known per se, after which the nucleic acid thus obtained can be expressed in a manner known per se, so as to provide the desired Nanobody of the invention.

Other suitable methods and techniques for obtaining the Nanobodies of the invention and/or nucleic acids encoding the same, starting from naturally occurring V$_H$ sequences or preferably V$_{HH}$ sequences, will be clear from the skilled person, and may for example comprise combining one or more parts of one or more naturally occurring V$_H$ sequences (such as one or more FR sequences and/or CDR sequences), one or more parts of one or more naturally occurring V$_{HH}$ sequences (such as one or more FR sequences or CDR sequences), and/or one or more synthetic or semi-synthetic sequences, in a suitable manner, so as to provide a Nanobody of the invention or a nucleotide sequence or nucleic acid encoding the same (which may then be suitably expressed). Nucleotide sequences encoding framework sequences of V$_{HH}$ sequences or Nanobodies will be clear to the skilled person based on the disclosure herein and/or the further prior art cited herein (and/or may alternatively be obtained by PCR starting from the nucleotide sequences obtained using the methods described herein) and may be suitably combined with nucleotide sequences that encode the desired CDR's (for example, by PCR assembly using overlapping primers), so as to provide a nucleic acid encoding a Nanobody of the invention.

As mentioned herein, Nanobodies may in particular be characterized by the presence of one or more "Hallmark residues" (as described herein) in one or more of the framework sequences.

Thus, according to one preferred, but non-limiting aspect of the invention, a Nanobody in its broadest sense can be generally defined as a polypeptide comprising:

a) an amino acid sequence that is comprised of four framework regions/sequences interrupted by three complementarity determining regions/sequences, in which the amino acid residue at position 108 according to the Kabat numbering is Q;

and/or:

b) an amino acid sequence that is comprised of four framework regions/sequences interrupted by three complementarity determining regions/sequences, in which the amino acid residue at position 45 according to the Kabat numbering is a charged amino acid (as defined herein) or a cysteine residue, and position 44 is preferably an E;

and/or:

c) an amino acid sequence that is comprised of four framework regions/sequences interrupted by three complementarity determining regions/sequences, in which the amino acid residue at position 103 according to the Kabat numbering is chosen from the group consisting of P, R and S, and is in particular chosen from the group consisting of R and S.

Thus, in a first preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which a) the amino acid residue at position 108 according to the Kabat numbering is Q;

and/or in which:

b) the amino acid residue at position 45 according to the Kabat numbering is a charged amino acid or a cysteine and the amino acid residue at position 44 according to the Kabat numbering is preferably E;

and/or in which:

c) the amino acid residue at position 103 according to the Kabat numbering is chosen from the group consisting of P, R and S, and is in particular chosen from the group consisting of R and S;

and in which:

d) CDR1, CDR2 and CDR3 are as defined herein, and are preferably as defined according to one of the preferred aspects herein, and are more preferably as defined according to one of the more preferred aspects herein.

In particular, a Nanobody in its broadest sense can be generally defined as a polypeptide comprising:

a) an amino acid sequence that is comprised of four framework regions/sequences interrupted by three complementarity determining regions/sequences, in which the amino acid residue at position 108 according to the Kabat numbering is Q;

and/or:

b) an amino acid sequence that is comprised of four framework regions/sequences interrupted by three complementarity determining regions/sequences, in which the amino acid residue at position 44 according to the Kabat numbering is E and in which the amino acid residue at position 45 according to the Kabat numbering is an R;

and/or:

c) an amino acid sequence that is comprised of four framework regions/sequences interrupted by three complementarity determining regions/sequences, in which the amino acid residue at position 103 according to the Kabat numbering is chosen from the group consisting of P, R and S, and is in particular chosen from the group consisting of R and S.

Thus, according to a preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which a) the amino acid residue at position 108 according to the Kabat numbering is Q;

and/or in which:

b) the amino acid residue at position 44 according to the Kabat numbering is E and in which the amino acid residue at position 45 according to the Kabat numbering is an R;

and/or in which:

c) the amino acid residue at position 103 according to the Kabat numbering is chosen from the group consisting of P, R and S, and is in particular chosen from the group consisting of R and S;

and in which:

d) CDR1, CDR2 and CDR3 are as defined herein, and are preferably as defined according to one of the preferred aspects herein, and are more preferably as defined according to one of the more preferred aspects herein.

In particular, a Nanobody against an APC target or T-cell target according to the invention may have the structure:

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which a) the amino acid residue at position 108 according to the Kabat numbering is Q;

and/or in which:

b) the amino acid residue at position 44 according to the Kabat numbering is E and in which the amino acid residue at position 45 according to the Kabat numbering is an R;

and/or in which:

c) the amino acid residue at position 103 according to the Kabat numbering is chosen from the group consisting of P, R and S, and is in particular chosen from the group consisting of R and S;

and in which:

d) CDR1, CDR2 and CDR3 are as defined herein, and are preferably as defined according to one of the preferred aspects herein, and are more preferably as defined according to one of the more preferred aspects herein.

In particular, according to one preferred, but non-limiting aspect of the invention, a Nanobody can generally be defined as a polypeptide comprising an amino acid sequence that is comprised of four framework regions/sequences interrupted by three complementarity determining regions/sequences, in which;

a-1) the amino acid residue at position 44 according to the Kabat numbering is chosen from the group consisting of A, G, E, D, G, Q, R, S, L; and is preferably chosen from the group consisting of G, E or Q; and a-2) the amino acid residue at position 45 according to the Kabat numbering is chosen from the group consisting of L, R or C; and is preferably chosen from the group consisting of L or R; and a-3) the amino acid residue at position 103 according to the Kabat numbering is chosen from the group consisting of W, R or S; and is preferably W or R, and is most preferably W;

a-4) the amino acid residue at position 108 according to the Kabat numbering is Q;

or in which:

b-1) the amino acid residue at position 44 according to the Kabat numbering is chosen from the group consisting of E and Q; and b-2) the amino acid residue at position 45 according to the Kabat numbering is R; and b-3) the amino acid residue at position 103 according to the Kabat numbering is chosen from the group consisting of W, R and S; and is preferably W;

b-4) the amino acid residue at position 108 according to the Kabat numbering is chosen from the group consisting of Q and L; and is preferably Q;

or in which:

c-1) the amino acid residue at position 44 according to the Kabat numbering is chosen from the group consisting of A, G, E, D, Q, R, S and L; and is preferably chosen from the group consisting of G, E and Q; and c-2) the amino acid residue at position 45 according to the Kabat numbering is chosen from the group consisting of L, R and C; and is preferably chosen from the group consisting of L and R; and c-3) the amino acid residue at position 103 according to the Kabat numbering is chosen from the group consisting of P, R and S; and is in particular chosen from the group consisting of R and S; and c-4) the amino acid residue at position 108 according to the Kabat numbering is chosen from the group consisting of Q and L; is preferably Q;

and in which d) CDR1, CDR2 and CDR3 are as defined herein, and are preferably as defined according to one of the preferred aspects herein, and are more preferably as defined according to one of the more preferred aspects herein.

Thus, in another preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

a-1) the amino acid residue at position 44 according to the Kabat numbering is chosen from the group consisting of A, G, E, D, G, Q, R, S, L; and is preferably chosen from the group consisting of G, E or Q;

and in which:

a-2) the amino acid residue at position 45 according to the Kabat numbering is chosen from the group consisting of L, R or C; and is preferably chosen from the group consisting of L or R;

and in which:

a-3) the amino acid residue at position 103 according to the Kabat numbering is chosen from the group consisting of W, R or S; and is preferably W or R, and is most preferably W;

and in which a-4) the amino acid residue at position 108 according to the Kabat numbering is Q;

and in which:

d) CDR1, CDR2 and CDR3 are as defined herein, and are preferably as defined according to one of the preferred aspects herein, and are more preferably as defined according to one of the more preferred aspects herein.

In another preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

b-1) the amino acid residue at position 44 according to the Kabat numbering is chosen from the group consisting of E and Q;

and in which:

b-2) the amino acid residue at position 45 according to the Kabat numbering is R;

and in which:

b-3) the amino acid residue at position 103 according to the Kabat numbering is chosen from the group consisting of W, R and S; and is preferably W;

and in which:

b-4) the amino acid residue at position 108 according to the Kabat numbering is chosen from the group consisting of Q and L; and is preferably Q;

and in which:

d) CDR1, CDR2 and CDR3 are as defined herein, and are preferably as defined according to one of the preferred aspects herein, and are more preferably as defined according to one of the more preferred aspects herein.

In another preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

c-1) the amino acid residue at position 44 according to the Kabat numbering is chosen from the group consisting of A, G, E, D, Q, R, S and L; and is preferably chosen from the group consisting of G, E and Q;

and in which:

c-2) the amino acid residue at position 45 according to the Kabat numbering is chosen from the group consisting of L, R and C; and is preferably chosen from the group consisting of L and R;

and in which:

c-3) the amino acid residue at position 103 according to the Kabat numbering is chosen from the group consisting of P, R and S; and is in particular chosen from the group consisting of R and S;

and in which:

c-4) the amino acid residue at position 108 according to the Kabat numbering is chosen from the group consisting of Q and L; is preferably Q;

and in which:

d) CDR1, CDR2 and CDR3 are as defined herein, and are preferably as defined according to one of the preferred aspects herein, and are more preferably as defined according to one of the more preferred aspects herein.

Two particularly preferred, but non-limiting groups of the Nanobodies of the invention are those according to a) above; according to (a-1) to (a-4) above; according to b) above; according to (b-1) to (b-4) above; according to (c) above; and/or according to (c-1) to (c-4) above, in which either:

i) the amino acid residues at positions 44-47 according to the Kabat numbering form the sequence GLEW (or a GLEW-like sequence as described herein) and the amino acid residue at position 108 is Q;

or in which:

ii) the amino acid residues at positions 43-46 according to the Kabat numbering form the sequence KERE or KQRE (or a KERE-like sequence as described) and the amino acid residue at position 108 is Q or L, and is preferably Q.

Thus, in another preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) the amino acid residues at positions 44-47 according to the Kabat numbering form the sequence GLEW (or a GLEW-like sequence as defined herein) and the amino acid residue at position 108 is Q;

and in which:

ii) CDR1, CDR2 and CDR3 are as defined herein, and are preferably as defined according to one of the preferred aspects herein, and are more preferably as defined according to one of the more preferred aspects herein.

In another preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) the amino acid residues at positions 43-46 according to the Kabat numbering form the sequence KERE or KQRE (or a KERE-like sequence) and the amino acid residue at position 108 is Q or L, and is preferably Q;

and in which:

ii) CDR1, CDR2 and CDR3 are as defined herein, and are preferably as defined according to one of the preferred aspects herein, and are more preferably as defined according to one of the more preferred aspects herein.

In the Nanobodies of the invention in which the amino acid residues at positions 43-46 according to the Kabat numbering form the sequence KERE or KQRE, the amino acid residue at position 37 is most preferably F. In the Nanobodies of the invention in which the amino acid residues at positions 44-47 according to the Kabat numbering form the sequence GLEW, the amino acid residue at position 37 is chosen from the group consisting of Y, H, I, L, V or F, and is most preferably V.

Thus, without being limited hereto in any way, on the basis of the amino acid residues present on the positions mentioned above, the Nanobodies of the invention can generally be classified on the basis of the following three groups:

i) The "GLEW-group": Nanobodies with the amino acid sequence GLEW at positions 44-47 according to the Kabat numbering and Q at position 108 according to the Kabat numbering. As further described herein, Nanobodies within this group usually have a V at position 37, and can have a W, P, R or S at position 103, and preferably have a W at position 103. The GLEW group also comprises some GLEW-like sequences such as those mentioned in Table A-3 below. More generally, and without limitation, Nanobodies belonging to the GLEW-group can be defined as Nanobodies with a G at position 44 and/or with a W at position 47, in which position 46 is usually E and in which preferably position 45 is not a charged amino acid residue and not cysteine;

ii) The "KERE-group": Nanobodies with the amino acid sequence KERE or KQRE (or another KERE-like sequence) at positions 43-46 according to the Kabat numbering and Q or L at position 108 according to the Kabat numbering. As further described herein, Nanobodies within this group usually have a F at position 37, an L or F at position 47; and can have a W, P, R or S at position 103, and preferably have a W at position 103. More generally, and without limitation, Nanobodies belonging to the KERE-group can be defined as Nanobodies with a K, Q or R at position 44 (usually K) in which position 45 is a charged amino acid residue or cysteine, and position 47 is as further defined herein;

iii) The "103 P, R, S-group": Nanobodies with a P, R or S at position 103. These Nanobodies can have either the amino acid sequence GLEW at positions 44-47 according to the Kabat numbering or the amino acid sequence KERE or KQRE at positions 43-46 according to the Kabat numbering, the latter most preferably in combination with an F at position 37 and an L or an F at position 47 (as defined for the KERE-group); and can have Q or L at position 108 according to the Kabat numbering, and preferably have Q.

Also, where appropriate, Nanobodies may belong to (i.e. have characteristics of) two or more of these classes. For example, one specifically preferred group of Nanobodies has GLEW or a GLEW-like sequence at positions 44-47; P, R or S (and in particular R) at position 103; and Q at position 108 (which may be humanized to L).

More generally, it should be noted that the definitions referred to above describe and apply to Nanobodies in the form of a native (i.e. non-humanized) $V_{HH}$ sequence, and that humanized variants of these Nanobodies may contain other amino acid residues than those indicated above (i.e. one or more humanizing substitutions as defined herein). For example, and without limitation, in some humanized Nanobodies of the GLEW-group or the 103 P, R, S-group, Q at position 108 may be humanized to 108L. As already mentioned herein, other humanizing substitutions (and suitable combinations thereof) will become clear to the skilled person based on the disclosure herein. In addition, or alternatively, other potentially useful humanizing substitutions can be ascertained by comparing the sequence of the framework regions of a naturally occurring $V_{HH}$ sequence with the corresponding framework sequence of one or more closely related human $V_H$ sequences, after which one or more of the potentially useful humanizing substitutions (or combinations thereof) thus determined can be introduced into said $V_{HH}$ sequence (in any manner known per se, as further described herein) and the resulting humanized $V_{HH}$ sequences can be tested for affinity for the target, for stability, for ease and level of expression, and/or for other desired properties. In this way, by means of a limited degree of trial and error, other suitable humanizing substitutions (or suitable combinations thereof) can be determined by the skilled person based on the disclosure herein. Also, based on the foregoing, (the framework regions of) a Nanobody may be partially humanized or fully humanized.

Thus, in another preferred, but non-limiting aspect, a Nanobody of the invention may be a Nanobody belonging to the GLEW-group (as defined herein), and in which CDR1, CDR2 and CDR3 are as defined herein, and are preferably as defined according to one of the preferred aspects herein, and are more preferably as defined according to one of the more preferred aspects herein.

In another preferred, but non-limiting aspect, a Nanobody of the invention may be a Nanobody belonging to the KERE-group (as defined herein), and CDR1, CDR2 and CDR3 are as defined herein, and are preferably as defined according to one of the preferred aspects herein, and are more preferably as defined according to one of the more preferred aspects herein.

Thus, in another preferred, but non-limiting aspect, a Nanobody of the invention may be a Nanobody belonging to the 103 P, R, S-group (as defined herein), and in which CDR1, CDR2 and CDR3 are as defined herein, and are preferably as defined according to one of the preferred aspects herein, and are more preferably as defined according to one of the more preferred aspects herein.

Also, more generally and in addition to the 108Q, 43E/44R and 103 P, R, S residues mentioned above, the Nanobodies of the invention can contain, at one or more positions that in a conventional $V_H$ domain would form (part of) the $V_H/V_L$ interface, one or more amino acid residues that are more highly charged than the amino acid residues that naturally occur at the same position(s) in the corresponding naturally occurring $V_H$ sequence, and in particular one or more charged amino acid residues (as mentioned in Table A-2). Such substitutions include, but are not limited to, the GLEW-like sequences mentioned in Table A-3 below; as well as the substitutions that are described in the International Application WO 00/29004 for so-called "microbodies", e.g. so as to obtain a Nanobody with Q at position 108 in combination with KLEW at positions 44-47. Other possible substitutions at these positions will be clear to the skilled person based upon the disclosure herein.

In one aspect of the Nanobodies of the invention, the amino acid residue at position 83 is chosen from the group consisting of L, M, S, V and W; and is preferably L.

Also, in one aspect of the Nanobodies of the invention, the amino acid residue at position 83 is chosen from the group consisting of R, K, N, E, G, I, T and Q; and is most preferably either K or E (for Nanobodies corresponding to naturally occurring $V_{HH}$ domains) or R (for "humanized" Nanobodies, as described herein). The amino acid residue at position 84 is chosen from the group consisting of P, A, R, S, D T, and V in one aspect, and is most preferably P (for Nanobodies corresponding to naturally occurring $V_{HH}$ domains) or R (for "humanized" Nanobodies, as described herein).

Furthermore, in one aspect of the Nanobodies of the invention, the amino acid residue at position 104 is chosen from the group consisting of G and D; and is most preferably G.

Collectively, the amino acid residues at positions 11, 37, 44, 45, 47, 83, 84, 103, 104 and 108, which in the Nanobodies are as mentioned above, will also be referred to herein as the "Hallmark Residues". The Hallmark Residues and the amino acid residues at the corresponding positions of the most closely related human $V_H$ domain, $V_H3$, are summarized in Table A-3.

Some especially preferred but non-limiting combinations of these Hallmark Residues as occur in naturally occurring $V_{HH}$ domains are mentioned in Table A-4. For comparison, the corresponding amino acid residues of the human $V_H3$ called DP-47 have been indicated in italics.

TABLE A-3

Hallmark Residues in Nanobodies

| Position | Human $V_H3$ | Hallmark Residues |
|---|---|---|
| 11 | L, V; predominantly L | L, M, S, V, W; preferably L |
| 37 | V, I, F; usually V | F$^{(1)}$, Y, H, I, L or V, preferably F$^{(1)}$ or Y |
| 44$^{(8)}$ | G | G$^{(2)}$, E$^{(3)}$, A, D, Q, R, S, L; preferably G$^{(2)}$, E$^{(3)}$ or Q; most preferably G$^{(2)}$ or E$^{(3)}$ |

TABLE A-3-continued

Hallmark Residues in Nanobodies

| Position | Human V$_H$3 | Hallmark Residues |
|---|---|---|
| 45[8] | L | L[2], R[3], C, I, L, P, Q, V; preferably L[2] or R[3] |
| 47[8] | W, Y | W[2], L[1] or F[1], A, G, I, M, R, S, V or Y; preferably W[2], L[1], F[1] or R |
| 83 | R or K; usually R | R, K[5], N, E[5], G, I, M, Q or T; preferably K or R; most preferably K |
| 84 | A, T, D; predominantly A | P[5], A, L, R, S, T, D, V; preferably P |
| 103 | W | W[4], P[6], R[6], S; preferably W |
| 104 | G | G or D; preferably G |
| 108 | L, M or T; predominantly L | Q, L[7] or R; preferably Q or L[7] |

Notes:
[1]In particular, but not exclusively, in combination with KERE or KQRE at positions 43-46.
[2]Usually as GLEW at positions 44-47.
[3]Usually as KERE or KQRE at positions 43-46, e.g. as KEREL, KEREF, KQREL, KQREF or KEREG at positions 43-47. Alternatively, also sequences such as TERE (for example TEREL), KECE (for example KECEL or KECER), RERE (for example REREG), QERE (for example QEREG), KGRE (for example KGREG), KDRE (for example KDREV) are possible. Some other possible, but less preferred sequences include for example DECKL and NVCEL.
[4]With both GLEW at positions 44-47 and KERE or KQRE at positions 43-46.
[5]Often as KP or EP at positions 83-84 of naturally occurring V$_{HH}$ domains.
[6]In particular, but not exclusively, in combination with GLEW at positions 44-47.
[7]With the proviso that when positions 44-47 are GLEW, position 108 is always Q in (non-humanized) V$_{HH}$ sequences that also contain a W at 103.
[8]The GLEW group also contains GLEW-like sequences at positions 44-47, such as for example GVEW, EPEW, GLER, DQEW, DLEW, GIEW, ELEW, GPEW, EWLP, GPER, GLER and ELEW.

TABLE A-4

Some preferred but non-limiting combinations of Hallmark Residues in naturally occurring Nanobodies. For humanization of these combinations, reference is made to the specification.

|  | 11 | 37 | 44 | 45 | 47 | 83 | 84 | 103 | 104 | 108 |
|---|---|---|---|---|---|---|---|---|---|---|
| DP-47 (human) | M | V | G | L | W | R | A | W | G | L |
| "KERE" group | L | F | E | R | L | K | P | W | G | Q |
|  | L | F | E | R | F | E | P | W | G | Q |
|  | L | F | E | R | F | K | P | W | G | Q |
|  | L | Y | Q | R | L | K | P | W | G | Q |
|  | L | F | L | R | V | K | P | Q | G | Q |
|  | L | F | Q | R | L | K | P | W | G | Q |
|  | L | F | E | R | F | K | P | W | G | Q |
| "GLEW" group | L | V | G | L | W | K | S | W | G | Q |
|  | M | V | G | L | W | K | P | R | G | Q |

In the Nanobodies, each amino acid residue at any other position than the Hallmark Residues can be any amino acid residue that naturally occurs at the corresponding position (according to the Kabat numbering) of a naturally occurring V$_{HH}$ domain.

Such amino acid residues will be clear to the skilled person. Tables A-5 to A-8 mention some non-limiting residues that can be present at each position (according to the Kabat numbering) of the FR1, FR2, FR3 and FR4 of naturally occurring V$_{HH}$ domains. For each position, the amino acid residue that most frequently occurs at each position of a naturally occurring V$_{HH}$ domain (and which is the most preferred amino acid residue for said position in a Nanobody) is indicated in bold; and other preferred amino acid residues for each position have been underlined (note: the number of amino acid residues that are found at positions 26-30 of naturally occurring V$_{HH}$ domains supports the hypothesis underlying the numbering by Chothia (supra) that the residues at these positions already form part of CDR1).

In Tables A-5-A-8, some of the non-limiting residues that can be present at each position of a human V$_H$3 domain have also been mentioned. Again, for each position, the amino acid residue that most frequently occurs at each position of a naturally occurring human V$_H$3 domain is indicated in bold; and other preferred amino acid residues have been underlined.

For reference only, Tables A-5-A-8 also contain data on the V$_{HH}$ entropy ("V$_{HH}$ Ent.") and V$_{HH}$ variability ("V$_{HH}$ Var.") at each amino acid position for a representative sample of 1118 V$_{HH}$ sequences (data kindly provided by David Lutje Hulsing and Prof. Theo Verrips of Utrecht University). The values for the V$_{HH}$ entropy and the V$_{HH}$ variability provide a measure for the variability and degree of conservation of amino acid residues between the 1118 V$_{HH}$ sequences analyzed: low values (i.e. <1, such as <0.5) indicate that an amino acid residue is highly conserved between the V$_{HH}$ sequences (i.e. little variability). For example, the G at position 8 and the G at position 9 have values for the V$_{HH}$ entropy of 0.1 and 0 respectively, indicating that these residues are highly conserved and have little variability (and in case of position 9 is G in all 1118 sequences analysed), whereas for residues that form part of the CDR's generally values of 1.5 or more are found (data not shown). Note that (1) the amino acid residues listed in the second column of Tables A-5-A-8 are based on a bigger sample than the 1118 V$_{HH}$ sequences that were analysed for determining the V$_{HH}$ entropy and V$_{HH}$ variability referred to in the last two columns; and (2) the data represented below support the hypothesis that the amino acid residues at positions 27-30 and maybe even also at positions 93 and 94 already form part of the CDR's (although the invention is not limited to any specific hypothesis or explanation, and as mentioned above, herein the numbering according to Kabat is used). For a general explanation of sequence entropy, sequence variability and the methodology for determining the same, see Oliveira et al., PROTEINS: Structure, Function and Genetics, 52: 544-552 (2003).

TABLE A-5

Non-limiting examples of amino acid residues in FR1 (for the footnotes, see the footnotes to Table A-3)

| | Amino acid residue(s): | | V$_{HH}$ | V$_{HH}$ |
|---|---|---|---|---|
| Pos. | Human V$_H$3 | Camelid V$_{HH}$'s | Ent. | Var. |
| 1 | E, Q | Q, A, E | — | — |
| 2 | V | V | 0.2 | 1 |
| 3 | Q | Q, K | 0.3 | 2 |
| 4 | L | L | 0.1 | 1 |
| 5 | V, L | Q, E, L, V | 0.8 | 3 |
| 6 | E | E, D, Q, A | 0.8 | 4 |
| 7 | S, T | S, F | 0.3 | 2 |
| 8 | G, R | G | 0.1 | 1 |
| 9 | G | G | 0 | 1 |
| 10 | G, V | G, D, R | 0.3 | 2 |
| 11 | Hallmark residue: L, M, S, V, W, preferably L | | 0.8 | 2 |
| 12 | V, I | V, A | 0.2 | 2 |
| 13 | Q, K, R | Q, E, K, P, R | 0.4 | 4 |
| 14 | P | A, Q, A, G, P, S, T, V | 1 | 5 |
| 15 | G | G | 0 | 1 |
| 16 | G, R | G, A, E, D | 0.4 | 3 |
| 17 | S | S, F | 0.5 | 2 |
| 18 | L | L, V | 0.1 | 1 |
| 19 | R, K | R, K, L, N, S, T | 0.6 | 4 |
| 20 | L | L, F, I, V | 0.5 | 4 |
| 21 | S | S, A, F, T | 0.2 | 3 |
| 22 | C | C | 0 | 1 |
| 23 | A, T | A, D, E, P, S, T, V | 1.3 | 5 |
| 24 | A | A, I, L, S, T, V | 1 | 6 |
| 25 | S | S, A, F, P, T | 0.5 | 5 |
| 26 | G | G, A, D, E, R, S, T, V | 0.7 | 7 |
| 27 | F | S, F, R, L, P, G, N, | 2.3 | 13 |
| 28 | T | N, T, E, D, S, I, R, A, G, R, F, Y | 1.7 | 11 |

TABLE A-5-continued

Non-limiting examples of amino acid residues in FR1
(for the footnotes, see the footnotes to Table A-3)

| | | Amino acid residue(s): | $V_{HH}$ | $V_{HH}$ |
|---|---|---|---|---|
| Pos. | Human $V_H3$ | Camelid $V_{HH}$'s | Ent. | Var. |
| 29 | F, $\underline{V}$ | F, L, D, S, I, G, V, A | 1.9 | 11 |
| 30 | S, $\underline{D}$, G | N, S, E, G, A, D, M, T | 1.8 | 11 |

TABLE A-6

Non-limiting examples of amino acid residues in FR2
(for the footnotes, see the footnotes to Table A-3)

| | | Amino acid residue(s): | $V_{HH}$ | $V_{HH}$ |
|---|---|---|---|---|
| Pos. | Human $V_H3$ | Camelid $V_{HH}$'s | Ent. | Var. |
| 36 | W | W | 0.1 | 1 |
| 37 | | Hallmark residue: F[1], H, I, L, Y or V, preferably F[1] or Y | 1.1 | 6 |
| 38 | R | R | 0.2 | 1 |
| 39 | Q | Q, H, P, R | 0.3 | 2 |
| 40 | A | A, F, G, L, P, T, V | 0.9 | 7 |
| 41 | P, S, T | P, A, L, S | 0.4 | 3 |
| 42 | G | G, E | 0.2 | 2 |
| 43 | K | K, D, E, N, Q, R, T, V | 0.7 | 6 |
| 44 | | Hallmark residue: G[2], E[3], A, D, Q, R, S, L; preferably G[2], E[3] or Q; most preferably G[2] or E[3]. | 1.3 | 5 |
| 45 | | Hallmark residue: L[2], R[3], C, I, L, P, Q, V; preferably L[2] or R[3] | 0.6 | 4 |
| 46 | E, V | E, D, K, Q, V | 0.4 | 2 |
| 47 | | Hallmark residue: W[2], L[1] or F[1], A, G, I, M, R, S, V or Y; preferably W[2], L[1], F[1] or R | 1.9 | 9 |
| 48 | V | V, I, L | 0.4 | 3 |
| 49 | S, $\underline{A}$, $\underline{G}$ | A, $\underline{S}$, G, T, V | 0.8 | 3 |

TABLE A-7

Non-limiting examples of amino acid residues in FR3
(for the footnotes, see the footnotes to Table A-3)

| | | Amino acid residue(s): | $V_{HH}$ | $V_{HH}$ |
|---|---|---|---|---|
| Pos. | Human $V_H3$ | Camelid $V_{HH}$'s | Ent. | Var. |
| 66 | R | R | 0.1 | 1 |
| 67 | F | F, L, V | 0.1 | 1 |
| 68 | T | T, A, N, S | 0.5 | 4 |
| 69 | I | I, L, M, V | 0.4 | 4 |
| 70 | S | S, A, F, T | 0.3 | 4 |
| 71 | R | R, G, H, I, L, K, Q, S, T, W | 1.2 | 8 |
| 72 | D, E | D, E, G, N, V | 0.5 | 4 |
| 73 | N, D, G | N, A, D, F, I, K, L, R, S, T, V, Y | 1.2 | 9 |
| 74 | A, S | A, D, G, N, P, S, T, V | 1 | 7 |
| 75 | K | K, A, E, K, L, N, Q, R | 0.9 | 6 |
| 76 | N, S | N, D, K, R, S, T, Y | 0.9 | 6 |
| 77 | $\underline{S}$, $\underline{T}$, I | T, A, E, I, M, P, S | 0.8 | 5 |
| 78 | L, A | V, $\underline{L}$, A, F, G, I, M | 1.2 | 5 |
| 79 | Y, H | Y, A, D, F, H, N, S, T | 1 | 7 |
| 80 | L | L, F, V | 0.1 | 1 |
| 81 | Q | Q, E, I, L, R, T | 0.6 | 5 |
| 82 | M | M, I, L, V | 0.2 | 2 |
| 82a | N, G | N, D, G, H, S, T | 0.8 | 4 |
| 82b | S | S, $\underline{N}$, D, G, R, T | 1 | 6 |
| 82c | L | L, P, V | 0.1 | 2 |
| 83 | Hallmark residue: R, K[5], N, E[5], G, I, M, Q or T; preferably K or R; most preferably K | | 0.9 | 7 |
| 84 | Hallmark residue: P[5], A, D, L, R, S, T, V; preferably P | | 0.7 | 6 |

TABLE A-7-continued

Non-limiting examples of amino acid residues in FR3
(for the footnotes, see the footnotes to Table A-3)

| | | Amino acid residue(s): | $V_{HH}$ | $V_{HH}$ |
|---|---|---|---|---|
| Pos. | Human $V_H3$ | Camelid $V_{HH}$'s | Ent. | Var. |
| 85 | E, G | E, D, G, Q | 0.5 | 3 |
| 86 | D | D | 0 | 1 |
| 87 | T, M | T, A, S | 0.2 | 3 |
| 88 | A | A, $\underline{G}$, S | 0.3 | 2 |
| 89 | V, L | V, A, D, I, L, M, N, R, T | 1.4 | 6 |
| 90 | Y | Y, F | 0 | 1 |
| 91 | Y, H | Y, D, F, H, L, S, T, V | 0.6 | 4 |
| 92 | C | C | 0 | 1 |
| 93 | A, K, T | A, $\underline{N}$, G, H, K, N, R, S, T, V, Y | 1.4 | 10 |
| 94 | K, R, T | A, $\underline{V}$, C, F, G, I, K, L, R, S or T | 1.6 | 9 |

TABLE A-8

Non-limiting examples of amino acid residues in FR4
(for the footnotes, see the footnotes to Table A-3)

| | | Amino acid residue(s): | $V_{HH}$ | $V_{HH}$ |
|---|---|---|---|---|
| Pos. | Human $V_H3$ | Camelid $V_{HH}$'s | Ent. | Var. |
| 103 | | Hallmark residue: W[4], P[6], R[6], S; preferably W | 0.4 | 2 |
| 104 | | Hallmark residue: G or D; preferably G | 0.1 | 1 |
| 105 | Q, $\underline{R}$ | Q, E, K, P, R | 0.6 | 4 |
| 106 | G | G | 0.1 | 1 |
| 107 | T | T, A, I | 0.3 | 2 |
| 108 | | Hallmark residue: Q, L[7] or R; preferably Q or L[7] | 0.4 | 3 |
| 109 | V | V | 0.1 | 1 |
| 110 | T | T, I, A | 0.2 | 1 |
| 111 | V | V, A, I | 0.3 | 2 |
| 112 | S | S, F | 0.3 | 1 |
| 113 | S | S, A, L, P, T | 0.4 | 3 |

Thus, in another preferred, but not limiting aspect, a Nanobody of the invention can be defined as an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) one or more of the amino acid residues at positions 11, 37, 44, 45, 47, 83, 84, 103, 104 and 108 according to the Kabat numbering are chosen from the Hallmark residues mentioned in Table A-3;

and in which:

ii) CDR1, CDR2 and CDR3 are as defined herein, and are preferably as defined according to one of the preferred aspects herein, and are more preferably as defined according to one of the more preferred aspects herein.

The above Nanobodies may for example be $V_{HH}$ sequences or may be humanized Nanobodies. When the above Nanobody sequences are $V_{HH}$ sequences, they may be suitably humanized, as further described herein. When the Nanobodies are partially humanized Nanobodies, they may optionally be further suitably humanized, again as described herein.

In particular, a Nanobody of the invention can be an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) (preferably) one or more of the amino acid residues at positions 11, 37, 44, 45, 47, 83, 84, 103, 104 and 108 according to the Kabat numbering are chosen from the Hallmark residues mentioned in Table A-3 (it being understood that $V_{HH}$ sequences will contain one or more Hallmark residues; and that partially humanized Nanobodies will usually, and preferably, [still] contain one or more Hallmark residues [although it is also within the scope of the invention to provide—where suitable in accordance with the invention—partially humanized Nanobodies in which all Hallmark residues, but not one or more of the other amino acid residues, have been humanized]; and that in fully humanized Nanobodies, where suitable in accordance with the invention, all amino acid residues at the positions of the Hallmark residues will be amino acid residues that occur in a human $V_H3$ sequence. As will be clear to the skilled person based on the disclosure herein that such $V_{HH}$ sequences, such partially humanized Nanobodies with at least one Hallmark residue, such partially humanized Nanobodies without Hallmark residues and such fully humanized Nanobodies all form aspects of this invention);

and in which:

ii) said amino acid sequence has at least 80% amino acid identity with at least one of the amino acid sequences of SEQ ID NO's: 1 to 22, in which for the purposes of determining the degree of amino acid identity, the amino acid residues that form the CDR sequences (indicated with X in the sequences of SEQ ID NO's: 1 to 22) are disregarded;

and in which:

iii) CDR1, CDR2 and CDR3 are as defined herein, and are preferably as defined according to one of the preferred aspects herein, and are more preferably as defined according to one of the more preferred aspects herein.

The above Nanobodies may for example be $V_{HH}$ sequences or may be humanized Nanobodies. When the above Nanobody sequences are $V_{HH}$ sequences, they may be suitably humanized, as further described herein. When the Nanobodies are partially humanized Nanobodies, they may optionally be further suitably humanized, again as described herein.

TABLE A-9

Representative amino acid sequences for Nanobodies of the KERE, GLEW and P, R, S 103 group. The CDR's are indicated with XXXX

| | | |
|---|---|---|
| KERE sequence no. 1 | SEQ ID NO: 1 | EVQLVESGGGLVQPGGSLRLSCAASGIPFSXXXXXXWFRQAPGKQRDSVAXXXXXXRFTISRDNAKNTVYLQMNSLKPEDTAVYRCYFXXXXXXWGQGTQVTVSS |
| KERE sequence no. 2 | SEQ ID NO: 2 | QVKLEESGGGLVQAGGSLRLSCVGSGRTFSXXXXXXWFRLAPGKEREFVAXXXXXXRFTISRDTASNRGYLHMNNLTPEDTAVYYCAAXXXXXXWGQGTQVTVSS |
| KERE sequence no. 3 | SEQ ID NO: 3 | AVQLVDSGGGLVQAGDSLKLSCALTGGAFTXXXXXXWFRQTPGREREFVAXXXXXXRFTISRDNAKNMVYLRMNSLIPEDAAVYSCAAXXXXXXWGQGTLVTVSS |
| KERE sequence no. 4 | SEQ ID NO: 4 | QVQLVESGGGLVEAGGSLRLSCTASESPFRXXXXXXWFRQTSGQEREFVAXXXXXXRFTISRDDAKNTVWLHGSTLKPEDTAVYYCAAXXXXXXWGQGTQVTVSS |
| KERE sequence no. 5 | SEQ ID NO: 5 | AVQLVESGGGLVQGGGSLRLACAASERIFDXXXXXXWYRQGPGNERELVAXXXXXXRFTISMDYTKQTVYLHMNSLRPEDTGLYYCKIXXXXXXWGQGTQVTVSS |
| KERE sequence no. 6 | SEQ ID NO: 6 | DVKFVESGGGLVQAGGSLRLSCVASGFNFDXXXXXXWFRQAPGKEREEVAXXXXXXRFTISSEKDKNSVYLQMNSLKPEDTALYICAGXXXXXXWGRGTQVTVSS |
| KERE sequence no. 7 | SEQ ID NO: 7 | QVRLAESGGGLVQSGGSLRLSCVASGSTYTXXXXXXWYRQYPGKQRALVAXXXXXXRFTIARDSTKDTFCLQMNNLKPEDTAVYYCYAXXXXXXWGQGTQVTVSS |
| KERE sequence no. 8 | SEQ ID NO: 8 | EVQLVESGGGLVQAGGSLRLSCAASGFTSDXXXXXXWFRQAPGKPREGVSXXXXXXRFTISTDNAKNTVHLLMNRVNAEDTALYYCAVXXXXXXWGRGTRVTVSS |
| KERE sequence no. 9 | SEQ ID NO: 9 | QVQLVESGGGLVQPGGSLRLSCQASGDISTXXXXXXWYRQVPGKLREFVAXXXXXXRFTISGDNAKRAIYLQMNNLKPDDTAVYYCNRXXXXXXWGQGTQVTVSP |
| KERE sequence no. 10 | SEQ ID NO: 10 | QVPVVESGGGLVQAGDSLRLFCAVPSFTSTXXXXXXWFRQAPGKEREFVAXXXXXXRFTISRNATKNTLTLRMDSLKPEDTAVYYCAAXXXXXXWGQGTQVTVSS |
| KERE sequence no. 11 | SEQ ID NO: 11 | EVQLVESGGGLVQAGDSLRLFCTVSGGTASXXXXXXWFRQAPGEKREFVAXXXXXXRFTIARENAGNMVYLQMNNLKPDDTALYTCAAXXXXXXWGRGTQVTVSS |
| KERE sequence no. 12 | SEQ ID NO: 12 | AVQLVESGGDSVQPGDSQTLSCAASGRTNSXXXXXXWFRQAPGKERVFLAXXXXXXRFTISRDSAKNMMYLQMNNLKPQDTAVYYCAAXXXXXXWGQGTQVTVSS |
| KERE sequence no. 13 | SEQ ID NO: 13 | AVQLVESGGGLVQAGGSLRLSCVVSGLTSSXXXXXXWFRQTPWQERDFVAXXXXXXRFTISRDNYKDTVLLEMNFLKPEDTAIYYCAAXXXXXXWGQGTQVTVSS |
| KERE sequence no. 14 | SEQ ID NO: 14 | AVQLVESGGGLVQAGASLRLSCATSTRTLDXXXXXXWFRQAPGRDREFVAXXXXXXRFTVSRDSAENTVALQMNSLKPEDTAVYYCAAXXXXXXWGQGTRVTVSS |
| KERE sequence no. 15 | SEQ ID NO: 15 | QVQLVESGGGLVQPGGSLRLSCTVSRLTAHXXXXXXWFRQAPGKEREAVSXXXXXXRFTISRDYAGNTAFLQMDSLKPEDTGVYYCATXXXXXXWGQGTQVTVSS |
| KERE sequence no. 16 | SEQ ID NO: 16 | EVQLVESGGELVQAGGSLKLSCTASGRNFVXXXXXXWFRRAPGKEREFVAXXXXXXRFTVSRDNGKNTAYLRMNSLKPEDTADYYCAVXXXXXXLGSGTQVTVSS |
| GLEW sequence no. 1 | SEQ ID NO: 17 | AVQLVESGGGLVQPGGSLRLSCAASGFTFSXXXXXXWVRQAPGKVLEWVSXXXXXXRFTISRDNAKNTLYLQMNSLKPEDTAVYYCVKXXXXXXGSQGTQVTVSS |

TABLE A-9-continued

Representative amino acid sequences for Nanobodies of the KERE, GLEW and P, R, S 103 group.
The CDR's are indicated with XXXX

| | | |
|---|---|---|
| GLEW sequence no. 2 | SEQ ID NO: 18 | EVQLVESGGGLVQPGGSLRLSCVCVSSGCTXXXXXXWVRQAPGKAEEWVSXXXXXXRFKISRDNAKKTLYLQMNSLGPEDTAMYYCQRXXXXXXRGQGTQVTVSS |
| GLEW sequence no. 3 | SEQ ID NO: 19 | EVQLVESGGGLALPGGSLTLSCVFSGSTFSXXXXXXWVRHTPGKAEEWVSXXXXXRFTISRDNAKNTLYLEMNSLSPEDTAMYYCGRXXXXXXRSKGIQVTVSS |
| P, R, S 103 sequence no. 1 | SEQ ID NO: 20 | AVQLVESGGGLVQAGGSLRLSCAASGRTFSXXXXXXWFRQAPGKEREFVAXXXXXXRFTISRDNAKNTVYLQMNSLKPEDTAVYYCAAXXXXXXRGQGTQVTVSS |
| P, R, S 103 sequence no. 2 | SEQ ID NO: 21 | DVQLVESGGDLVQPGGSLRLSCAASGFSFDXXXXXXWLRQTPGKGLEWVGXXXXXRFTISRDNAKNMLYLHLNNLKSEDTAVYYCRRXXXXXLGQGTQVTVSS |
| P, R, S 103 sequence no. 3 | SEQ ID NO: 22 | EVQLVESGGGLVQPGGSLRLSCVCVSSGCTXXXXXXWVRQAPGKAEEWVSXXXXXXRFKISRDNAKKTLYLQMNSLGPEDTAMYYCQRXXXXXXRGQGTQVTVSS |

In particular, a Nanobody of the invention of the KERE group can be an amino acid sequence with the (general) structure

FR1-CDR1-FR2-CDR2-FR3-CDR3-FR4 in which:

i) the amino acid residue at position 45 according to the Kabat numbering is a charged amino acid (as defined herein) or a cysteine residue, and position 44 is preferably an E;

and in which:

ii) FR1 is an amino acid sequence that has at least 80% amino acid identity with at least one of the following amino acid sequences:

TABLE A-10

Representative FW1 sequences for Nanobodies of the KERE-group.

| | | |
|---|---|---|
| KERE FW1 sequence no. 1 | SEQ ID NO: 23 | QVQRVESGGGLVQAGGSLRLSCAASGRTSS |
| KERE FW1 sequence no. 2 | SEQ ID NO: 24 | QVQLVESGGGLVQTGDSLSLSCSASGRTFS |
| KERE FW1 sequence no. 3 | SEQ ID NO: 25 | QVKLEESGGGLVQAGDSLRLSCAATGRAFG |
| KERE FW1 sequence no. 4 | SEQ ID NO: 26 | AVQLVESGGGLVQPGESLGLSCVASGRDFV |
| KERE FW1 sequence no. 5 | SEQ ID NO: 27 | EVQLVESGGGLVQAGGSLRLSCEVLGRTAG |
| KERE FW1 sequence no. 6 | SEQ ID NO: 28 | QVQLVESGGGWVQPGGSLRLSCAASETILS |
| KERE FW1 sequence no. 7 | SEQ ID NO: 29 | QVQLVESGGGTVQPGGSLNLSCVASGNTFN |
| KERE FW1 sequence no. 8 | SEQ ID NO: 30 | EVQLVESGGGLAQPGGSLQLSCSAPGFTLD |
| KERE FW1 sequence no. 9 | SEQ ID NO: 31 | AQELEESGGGLVQAGGSLRLSCAASGRTFN | and in which:

iii) FR2 is an amino acid sequence that has at least 80% amino acid identity with at least one of the following amino acid sequences:

TABLE A-11

Representative FW2 sequences for Nanobodies of the KERE-group.

| | | |
|---|---|---|
| KERE FW2 sequence no. 1 | SEQ ID NO: 41 | WFRQAPGKEREFVA |
| KERE FW2 sequence no. 2 | SEQ ID NO: 42 | WFRQTPGREREFVA |
| KERE FW2 sequence no. 3 | SEQ ID NO: 43 | WYRQAPGKQREMVA |
| KERE FW2 sequence no. 4 | SEQ ID NO: 44 | WYRQGPGKQRELVA |
| KERE FW2 sequence no. 5 | SEQ ID NO: 45 | WIRQAPGKEREGVS |
| KERE FW2 sequence no. 6 | SEQ ID NO: 46 | WFREAPGKEREGIS |
| KERE FW2 sequence no. 7 | SEQ ID NO: 47 | WYRQAPGKERDLVA |
| KERE FW2 sequence no. 8 | SEQ ID NO: 48 | WFRQAPGKQREEVS |
| KERE FW2 sequence no. 9 | SEQ ID NO: 49 | WFRQPPGKVREFVG | and in which:

iv) FR3 is an amino acid sequence that has at least 80% amino acid identity with at least one of the following amino acid sequences:

TABLE A-12

Representative FW3 sequences for Nanobodies of the KERE-group.

| | | |
|---|---|---|
| KERE FW3 sequence no. 1 | SEQ ID NO: 50 | RFTISRDNAKNTVYLQMNSLKPEDTAVYRCYF |
| KERE FW3 sequence no. 2 | SEQ ID NO: 51 | RFAISRDNNKNTGYLQMNSLEPEDTAVYYCAA |

TABLE A-12-continued

Representative FW3 sequences for Nanobodies of the KERE-group.

| | | |
|---|---|---|
| KERE FW3 sequence no. 3 | SEQ ID NO: 52 | RFTVARNNAKNTVNLEMNSLKPEDTAVYYCAA |
| KERE FW3 sequence no. 4 | SEQ ID NO: 53 | RFTISRDIAKNTVDLLMNNLEPEDTAVYYCAA |
| KERE FW3 sequence no. 5 | SEQ ID NO: 54 | RLTISRDNAVDTMYLQMNSLKPEDTAVYYCAA |
| KERE FW3 sequence no. 6 | SEQ ID NO: 55 | RFTISRDNAKNTVYLQMDNVKPEDTAIYYCAA |
| KERE FW3 sequence no. 7 | SEQ ID NO: 56 | RFTISKDSGKNTVYLQMTSLKPEDTAVYYCAT |
| KERE FW3 sequence no. 8 | SEQ ID NO: 57 | RFTISRDSAKNMMYLQMNNLKPQDTAVYYCAA |
| KERE FW3 sequence no. 9 | SEQ ID NO: 58 | RFTISRENDKSTVYLQLNSLKPEDTAVYYCAA |
| KERE FW3 sequence no. 10 | SEQ ID NO: 59 | RFTISRDYAGNTAYLQMNSLKPEDTGVYYCAT | and in which:

v) FR4 is an amino acid sequence that has at least 80% amino acid identity with at least one of the following amino acid sequences:

TABLE A-13

Representative FW4 sequences for Nanobodies of the KERE-group.

| | | |
|---|---|---|
| KERE FW4 sequence no. 1 | SEQ ID NO: 60 | WGQGTQVTVSS |
| KERE FW4 sequence no. 2 | SEQ ID NO: 61 | WGKGTLVTVSS |
| KERE FW4 sequence no. 3 | SEQ ID NO: 62 | RGQGTRVTVSS |
| KERE FW4 sequence no. 4 | SEQ ID NO: 63 | WGLGTQVTISS | and in which:

vi) CDR1, CDR2 and CDR3 are as defined herein, and are preferably as defined according to one of the preferred aspects herein, and are more preferably as defined according to one of the more preferred aspects herein.

In the above Nanobodies, one or more of the further Hallmark residues are preferably as described herein (for example, when they are $V_{HH}$ sequences or partially humanized Nanobodies).

Also, the above Nanobodies may for example be $V_{HH}$ sequences or may be humanized Nanobodies. When the above Nanobody sequences are $V_{HH}$ sequences, they may be suitably humanized, as further described herein. When the Nanobodies are partially humanized Nanobodies, they may optionally be further suitably humanized, again as described herein.

With regard to framework 1, it will be clear to the skilled person that, when an amino acid sequence as outlined above is generated by expression of a nucleotide sequence, the first four amino acid sequences (i.e. amino acid residues 1-4 according to the Kabat numbering) may often be determined by the primer(s) that have been used to generate said nucleic acid. Thus, for determining the degree of amino acid identity, the first four amino acid residues are preferably disregarded.

Also, with regard to framework 1, and although amino acid positions 27 to 30 are according to the Kabat numbering considered to be part of the framework regions (and not the CDR's), it has been found by analysis of a database of more than 1000 $V_{HH}$ sequences that the positions 27 to 30 have a variability (expressed in terms of $V_{HH}$ entropy and $V_{HH}$ variability—see Tables A-5 to A-8) that is much greater than the variability on positions 1 to 26. Because of this, for determining the degree of amino acid identity, the amino acid residues at positions 27 to 30 are preferably also disregarded.

In view of this, a Nanobody of the KERE class may be an amino acid sequence that is comprised of four framework regions/sequences interrupted by three complementarity determining regions/sequences, in which:

i) the amino acid residue at position 45 according to the Kabat numbering is a charged amino acid (as defined herein) or a cysteine residue, and position 44 is preferably an E;

and in which:

ii) FR1 is an amino acid sequence that, on positions 5 to 26 of the Kabat numbering, has at least 80% amino acid identity with at least one of the following amino acid sequences:

TABLE A-14

Representative FW1 sequences (amino acid residues 5 to 26) for Nanobodies of the KERE-group.

| | | |
|---|---|---|
| KERE FW1 sequence no. 10 | SEQ ID NO: 32 | VESGGGLVQPGGSLRLSCAASG |
| KERE FW1 sequence no. 11 | SEQ ID NO: 33 | VDSGGGLVQAGDSLKLSCALTG |
| KERE FW1 sequence no. 12 | SEQ ID NO: 34 | VDSGGGLVQAGDSLRLSCAASG |
| KERE FW1 sequence no. 13 | SEQ ID NO: 35 | VDSGGGLVEAGGSLRLSCQVSE |
| KERE FW1 sequence no. 14 | SEQ ID NO: 36 | QDSGGGSVQAGGSLKLSCAASG |
| KERE FW1 sequence no. 15 | SEQ ID NO: 37 | VQSGGRLVQAGDSLRLSCAASE |
| KERE FW1 sequence no. 16 | SEQ ID NO: 38 | VESGGTLVQSGDSLKLSCASST |

TABLE A-14-continued

Representative FW1 sequences (amino acid residues 5 to 26) for Nanobodies of the KERE-group.

KERE FW1 sequence no. 17  SEQ ID NO: 39 MESGGDSVQSGGSLTLSCVASG

KERE FW1 sequence no. 18  SEQ ID NO: 40 QASGGGLVQAGGSLRLSCSASV and in which:

iii) FR2, FR3 and FR4 are as mentioned herein for FR2, FR3 and FR4 of Nanobodies of the KERE-class;

and in which:

iv) CDR1, CDR2 and CDR3 are as defined herein, and are preferably as defined according to one of the preferred aspects herein, and are more preferably as defined according to one of the more preferred aspects herein.

The above Nanobodies may, for example be $V_{HH}$ sequences or may be humanized Nanobodies. When the above Nanobody sequences are $V_{HH}$ sequences, they may be suitably humanized, as further described herein. When the Nanobodies are partially humanized Nanobodies, they may optionally be further suitably humanized, again as described herein.

A Nanobody of the GLEW class may be an amino acid sequence that is comprised of four framework regions/sequences interrupted by three complementarity determining regions/sequences, in which i) preferably, when the Nanobody of the GLEW-class is a non-humanized Nanobody, the amino acid residue in position 108 is Q;

ii) FR1 is an amino acid sequence that has at least 80% amino acid identity with at least one of the following amino acid sequences:

TABLE A-15

Representative FW1 sequences for Nanobodies of the GLEW-group.

| | | |
|---|---|---|
| GLEW FW1 sequence no. 1 | SEQ ID NO: 64 | QVQLVESGGGLVQ PGGSLRLSCAASG FTFS |
| GLEW FW1 sequence no. 2 | SEQ ID NO: 65 | EVHLVESGGGLVR PGGSLRLSCAAFG FIFK |
| GLEW FW1 sequence no. 3 | SEQ ID NO: 66 | QVKLEESGGGLAQ PGGSLRLSCVASG FTFS |
| GLEW FW1 sequence no. 4 | SEQ ID NO: 67 | EVQLVESGGGLVQ PGGSLRLSCVCVS SGCT |
| GLEW FW1 sequence no. 5 | SEQ ID NO: 68 | EVQLVESGGGLAL PGGSLTLSCVFSG STFS | and in which:

iii) FR2 is an amino acid sequence that has at least 80% amino acid identity with at least one of the following amino acid sequences:

TABLE A-16

Representative FW2 sequences for Nanobodies of the GLEW-group.

| | | |
|---|---|---|
| GLEW FW2 sequence no. 1 | SEQ ID NO: 72 | WVRQAPGKVLEW VS |
| GLEW FW2 sequence no. 2 | SEQ ID NO: 73 | WVRRPPGKGLEW VS |
| GLEW FW2 sequence no. 3 | SEQ ID NO: 74 | WVRQAPGMGLEW VS |
| GLEW FW2 sequence no. 4 | SEQ ID NO: 75 | WVRQAPGKEPEW VS |
| GLEW FW2 sequence no. 5 | SEQ ID NO: 76 | WVRQAPGKDQEW VS |
| GLEW FW2 sequence no. 6 | SEQ ID NO: 77 | WVRQAPGKAEEW VS |
| GLEW FW2 sequence no. 7 | SEQ ID NO: 78 | WVRQAPGKGLEW VA |
| GLEW FW2 sequence no. 8 | SEQ ID NO: 79 | WVRQAPGRATEW VS | and in which:

iv) FR3 is an amino acid sequence that has at least 80% amino acid identity with at least one of the following amino acid sequences:

TABLE A-17

Representative FW3 sequences for Nanobodies of the GLEW-group.

| | | |
|---|---|---|
| GLEW FW3 sequence no. 1 | SEQ ID NO: 80 | RFTISRDNAKNTL YLQMNSLKPEDT AVYYCVK |
| GLEW FW3 sequence no. 2 | SEQ ID NO: 81 | RFTISRDNARNTL YLQMDSLIPEDT ALYYCAR |
| GLEW FW3 sequence no. 3 | SEQ ID NO: 82 | RFTSSRDNAKSTL YLQMNDLKPEDT ALYYCAR |
| GLEW FW3 sequence no. 4 | SEQ ID NO: 83 | RFIISRDNAKNT LYLQMNSLGPED TAMYYCQR |
| GLEW FW3 sequence no. 5 | SEQ ID NO: 84 | RFTASRDNAKNTL YLQMNSLKSEDTA RYYCAR |
| GLEW FW3 sequence no. 6 | SEQ ID NO: 85 | RFTISRDNAKNTL YLQMDDLQSEDTA MYYCGR | and in which:

v) FR4 is an amino acid sequence that has at least 80% amino acid identity with at least one of the following amino acid sequences:

TABLE A-18

Representative FW4 sequences for Nanobodies of the CLEW-group.

| | | |
|---|---|---|
| GLEW FW4 sequence no. 1 | SEQ ID NO: 86 | GSQGTQVTVSS |
| GLEW FW4 sequence no. 2 | SEQ ID NO: 87 | LRGGTQVTVSS |
| GLEW FW4 sequence no. 3 | SEQ ID NO: 88 | RGQGTLVTVSS |
| GLEW FW4 sequence no. 4 | SEQ ID NO: 89 | RSRGIQVTVSS |
| GLEW FW4 sequence no. 5 | SEQ ID NO: 90 | WGKGTQVTVSS |
| GLEW FW4 sequence no. 6 | SEQ ID NO: 91 | WGQGTQVTVSS | and in which:

vi) CDR1, CDR2 and CDR3 are as defined herein, and are preferably as defined according to one of the preferred aspects herein, and are more preferably as defined according to one of the more preferred aspects herein.

In the above Nanobodies, one or more of the further Hallmark residues are preferably as described herein (for example, when they are $V_{HH}$ sequences or partially humanized Nanobodies).

With regard to framework 1, it will again be clear to the skilled person that, for determining the degree of amino acid identity, the amino acid residues on positions 1 to 4 and 27 to 30 are preferably disregarded.

In view of this, a Nanobody of the GLEW class may be an amino acid sequence that is comprised of four framework regions/sequences interrupted by three complementarity determining regions/sequences, in which:

i) preferably, when the Nanobody of the GLEW-class is a non-humanized Nanobody, the amino acid residue in position 108 is Q;

and in which:

ii) FR1 is an amino acid sequence that, on positions 5 to 26 of the Kabat numbering, has at least 80% amino acid identity with at least one of the following amino acid sequences:

TABLE A-19

Representative FW1 sequences (amino acid residues 5 to 26) for Nanobodies of the KERE-group.

| | | |
|---|---|---|
| GLEW FW1 sequence no. 6 | SEQ ID NO: 69 | VESGGGLVQPGG SLRLSCAASG |
| GLEW FW1 sequence no. 7 | SEQ ID NO: 70 | EESGGGLAQPGG SLRLSCVASG |
| GLEW FW1 sequence no. 8 | SEQ ID NO: 71 | VESGGGLALPGG SLTLSCVFSG | and in which:

iii) FR2, FR3 and FR4 are as mentioned herein for FR2, FR3 and FR4 of Nanobodies of the GLEW-class;

and in which:

iv) CDR1, CDR2 and CDR3 are as defined herein, and are preferably as defined according to one of the preferred aspects herein, and are more preferably as defined according to one of the more preferred aspects herein.

The above Nanobodies may for example be $V_{HH}$ sequences or may be humanized Nanobodies. When the above Nanobody sequences are $V_{HH}$ sequences, they may be suitably humanized, as further described herein. When the Nanobodies are partially humanized Nanobodies, they may optionally be further suitably humanized, again as described herein. In the above Nanobodies, one or more of the further Hallmark residues are preferably as described herein (for example, when they are $V_{HH}$ sequences or partially humanized Nanobodies).

A Nanobody of the P, R, S 103 class may be an amino acid sequence that is comprised of four framework regions/sequences interrupted by three complementarity determining regions/sequences, in which i) the amino acid residue at position 103 according to the Kabat numbering is different from W;

and in which:

ii) preferably the amino acid residue at position 103 according to the Kabat numbering is P, R or S, and more preferably R;

and in which:

iii) FR1 is an amino acid sequence that has at least 80% amino acid identity with at least one of the following amino acid sequences:

TABLE A-20

Representative FW1 sequences for Nanobodies of the P, R, S 103-group.

| | | |
|---|---|---|
| P, R, S 103 FW1 sequence no. 1 | SEQ ID NO: 92 | AVQLVESGGGLVQAGGSLRLSCAASGRTFS |
| P, R, S 103 FW1 sequence no. 2 | SEQ ID NO: 93 | QVQLQESGGGMVQPGGSLRLSCAASGFDFG |
| P, R, S 103 FW1 sequence no. 3 | SEQ ID NO: 94 | EVHLVESGGGLVRPGGSLRLSCAAFGFIFK |
| P, R, S 103 FW1 sequence no. 4 | SEQ ID NO: 95 | QVQLAESGGGLVQPGGSLKLSCAASRTIVS |
| P, R, S 103 FW1 sequence no. 5 | SEQ ID NO: 96 | QEHLVESGGGLVDIGGSLRLSCAASERIFS |
| P, R, S 103 FW1 sequence no. 6 | SEQ ID NO: 97 | QVKLEESGGGLAQPGGSLRLSCVASGFTFS |
| P, R, S 103 FW1 sequence no. 7 | SEQ ID NO: 98 | EVQLVESGGGLVQPGGSLRLSCVCVSSGCT |
| P, R, S 103 FW1 sequence no. 8 | SEQ ID NO: 99 | EVQLVESGGGLALPGGSLTLSCVFSGSTFS | and in which
iv) FR2 is an amino acid sequence that has at least 80% amino acid identity with at least one of the following amino acid sequences:

TABLE A-21

Representative FW2 sequences for Nanobodies of the P, R, S 103-group.

| | | |
|---|---|---|
| P, R, S 103 FW2 sequence no. 1 | SEQ ID NO: 102 | WFRQAPGKEREFVA |
| P, R, S 103 FW2 sequence no. 2 | SEQ ID NO: 103 | WVRQAPGKVLEWVS |
| P, R, S 103 FW2 sequence no. 3 | SEQ ID NO: 104 | WVRRPPGKGLEWVS |
| P, R, S 103 FW2 sequence no. 4 | SEQ ID NO: 105 | WIRQAPGKEREGVS |
| P, R, S 103 FW2 sequence no. 5 | SEQ ID NO: 106 | WVRQYPGKEPEWVS |
| P, R, S 103 FW2 sequence no. 6 | SEQ ID NO: 107 | WFRQPPGKEHEFVA |
| P, R, S 103 FW2 sequence no. 7 | SEQ ID NO: 108 | WYRQAPGKRTELVA |
| P, R, S 103 FW2 sequence no. 8 | SEQ ID NO: 109 | WLRQAPGQGLEWVS |
| P, R, S 103 FW2 sequence no. 9 | SEQ ID NO: 110 | WLRQTPGKGLEWVG |
| P, R, S 103 FW2 sequence no. 10 | SEQ ID NO: 111 | WVRQAPGKAEEFVS | and in which:
v) FR3 is an amino acid sequence that has at least 80% amino acid identity with at least one of the following amino acid sequences:

TABLE A-22

Representative FW3 sequences for Nanobodies of the P, R, S 103-group.

| | | |
|---|---|---|
| P, R, S 103 FW3 sequence no. 1 | SEQ ID NO: 112 | RFTISRDNAKNTVYLQMNSLKPEDTAVYYCAA |
| P, R, S 103 FW3 sequence no. 2 | SEQ ID NO: 113 | RFTISRDNARNTLYLQMDSLIPEDTALYYCAR |
| P, R, S 103 FW3 sequence no. 3 | SEQ ID NO: 114 | RFTISRDNAKNEMYLQMNNLKTEDTGVYWCGA |
| P, R, S 103 FW3 sequence no. 4 | SEQ ID NO: 115 | RFTISSDSNRNMIYLQMNNLKPEDTAVYYCAA |
| P, R, S 103 FW3 sequence no. 5 | SEQ ID NO: 116 | RFTISRDNAKNMLYLHLNNLKSEDTAVYYCRR |
| P, R, S 103 FW3 sequence no. 6 | SEQ ID NO: 117 | RFTISRDNAKKTVYLRLNSLNPEDTAVYSCNL |
| P, R, S 103 FW3 sequence no. 7 | SEQ ID NO: 118 | RFKISRDNAKKTLYLQMNSLGPEDTAMYYCQR |
| P, R, S 103 FW3 sequence no. 8 | SEQ ID NO: 119 | RFTVSRDNGKNTAYLRMNSLKPEDTADYYCAV | and in which:
vi) FR4 is an amino acid sequence that has at least 80% amino acid identity with at least one of the following amino acid sequences:

TABLE A-23

Representative FW4 sequences for Nanobodies of the P, R, S 103-group.

| | | |
|---|---|---|
| P, R, S 103 FW4 sequence no. 1 | SEQ ID NO: 120 | RGQGTQVTVSS |
| P, R, S 103 FW4 sequence no. 2 | SEQ ID NO: 121 | LRGGTQVTVSS |
| P, R, S 103 FW4 sequence no. 3 | SEQ ID NO: 122 | GNKGTLVTVSS |
| P, R, S 103 FW4 sequence no. 4 | SEQ ID NO: 123 | SSPGTQVTVSS |
| P, R, S 103 FW4 sequence no. 5 | SEQ ID NO: 124 | SSQGTLVTVSS |
| P, R, S 103 FW4 sequence no. 6 | SEQ ID NO: 125 | RSRGIQVTVSS | and in which:
vii) CDR1, CDR2 and CDR3 are as defined herein, and are preferably as defined according to one of the preferred aspects herein, and are more preferably as defined according to one of the more preferred aspects herein.

In the above Nanobodies, one or more of the further Hallmark residues are preferably as described herein (for example, when they are $V_{HH}$ sequences or partially humanized Nanobodies).

With regard to framework 1, it will again be clear to the skilled person that, for determining the degree of amino acid identity, the amino acid residues on positions 1 to 4 and 27 to 30 are preferably disregarded.

In view of this, a Nanobody of the P, R, S 103 class may be an amino acid sequence that is comprised of four framework regions/sequences interrupted by three complementarity determining regions/sequences, in which:

i) the amino acid residue at position 103 according to the Kabat numbering is different from W;

and in which:

ii) preferably the amino acid residue at position 103 according to the Kabat numbering is P, R or S, and more preferably R;

and in which:

iii) FR1 is an amino acid sequence that, on positions 5 to 26 of the Kabat numbering, has at least 80% amino acid identity with at least one of the following amino acid sequences:

TABLE A-24

Representative FW1 sequences (amino acid residues 5 to 26) for Nanobodies of the P, R, S 103-group.

| | | |
|---|---|---|
| P, R, S 103 FW1 sequence no. 9 | SEQ ID NO: 100 | VESGGGLVQAGGSLRLSCAASG |
| P, R, S 103 FW1 sequence no. 10 | SEQ ID NO: 101 | AESGGGLVQPGGSLKLSCAASR | and in which:

iv) FR2, FR3 and FR4 are as mentioned herein for FR2, FR3 and FR4 of Nanobodies of the P, R, S 103 class;

and in which:

v) CDR1, CDR2 and CDR3 are as defined herein, and are preferably as defined according to one of the preferred aspects herein, and are more preferably as defined according to one of the more preferred aspects herein.

The above Nanobodies may for example be $V_{HH}$ sequences or may be humanized Nanobodies. When the above Nanobody sequences are $V_{HH}$ sequences, they may be suitably humanized, as further described herein. When the Nanobodies are partially humanized Nanobodies, they may optionally be further suitably humanized, again as described herein.

In the above Nanobodies, one or more of the further Hallmark residues are preferably as described herein (for example, when they are $V_{HH}$ sequences or partially humanized Nanobodies).

In another preferred, but non-limiting aspect, the invention relates to a Nanobody as described above, in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 266-285. This degree of amino acid identity can for example be determined by determining the degree of amino acid identity (in a manner described herein) between said Nanobody and one or more of the sequences of SEQ ID NO's: 266-285, in which the amino acid residues that form the framework regions are disregarded. Such Nanobodies can be as further described herein.

As already mentioned herein, another preferred but non-limiting aspect of the invention relates to a Nanobody with an amino acid sequence that is chosen from the group consisting of SEQ ID NO's: 266-285 or from the group consisting of from amino acid sequences that have more than 80%, preferably more than 90%, more preferably more than 95%, such as 99% or more sequence identity (as defined herein) with at least one of the amino acid sequences of SEQ ID NO's: 266-285.

Also, in the above Nanobodies:

i) any amino acid substitution (when it is not a humanizing substitution as defined herein) is preferably, and compared to the corresponding amino acid sequence of SEQ ID NO's: 266-285, a conservative amino acid substitution, (as defined herein);

and/or:

ii) its amino acid sequence preferably contains either only amino acid substitutions, or otherwise preferably no more than 5, preferably no more than 3, and more preferably only 1 or 2 amino acid deletions or insertions, compared to the corresponding amino acid sequence of SEQ ID NO's: 266-285;

and/or iii) the CDR's may be CDR's that are derived by means of affinity maturation, for example starting from the CDR's of to the corresponding amino acid sequence of SEQ ID NO's: 266-285.

Preferably, the CDR sequences and FR sequences in the Nanobodies of the invention are such that the Nanobodies of the invention (and polypeptides of the invention comprising the same):

bind to B7-1 and/or B7-2 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to B7-1 and/or B7-2 with a $k_{on}$-rate of between $10^2$ $M^{-1}$ $s^{-1}$ to about $10^7$ $M^{-1}$ $s^{-1}$, preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$;

and/or such that they:

bind to B7-1 and/or B7-2 with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, CDR sequences and FR sequences present in the Nanobodies of the invention are such that the Nanobodies of the invention will bind to B7-1 and/or B7-2 with an affinity less than 500 nM, preferably less than 200 nM, more preferably less than 10 nM, such as less than 500 pM.

In another preferred, but non-limiting aspect, the invention relates to a Nanobody as described above, in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 347-351. This degree of amino acid identity can for example be determined by determining the degree of amino acid identity (in a manner described herein) between said Nanobody and one or more of the sequences of SEQ ID NO's:

347-351, in which the amino acid residues that form the framework regions are disregarded. Such Nanobodies can be as further described herein.

As already mentioned herein, another preferred but non-limiting aspect of the invention relates to a Nanobody with an amino acid sequence that is chosen from the group consisting of SEQ ID NO's: 347-351 or from the group consisting of from amino acid sequences that have more than 80%, preferably more than 90%, more preferably more than 95%, such as 99% or more sequence identity (as defined herein) with at least one of the amino acid sequences of SEQ ID NO's: 347-351.

Also, in the above Nanobodies:
i) any amino acid substitution (when it is not a humanizing substitution as defined herein) is preferably, and compared to the corresponding amino acid sequence of SEQ ID NO's: 347-351, a conservative amino acid substitution, (as defined herein);
and/or:
ii) its amino acid sequence preferably contains either only amino acid substitutions, or otherwise preferably no more than 5, preferably no more than 3, and more preferably only 1 or 2 amino acid deletions or insertions, compared to the corresponding amino acid sequence of SEQ ID NO's: 347-351;
and/or
iii) the CDR's may be CDR's that are derived by means of affinity maturation, for example starting from the CDR's of to the corresponding amino acid sequence of SEQ ID NO's: 347-351.

Preferably, the CDR sequences and FR sequences in the Nanobodies of the invention are such that the Nanobodies of the invention (and polypeptides of the invention comprising the same):
bind to PD-1 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);
and/or such that they:
bind to PD-1 with a $k_{on}$-rate of between $10^2$ $M^{-1}$ $s^{-1}$ to about $10^7$ $M^{-1}$ $s^{-1}$, preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$;
and/or such that they:
bind to PD-1 with a $k_{off}$-rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, CDR sequences and FR sequences present in the Nanobodies of the invention are such that the Nanobodies of the invention will bind to PD-1 with an affinity less than 500 nM, preferably less than 200 nM, more preferably less than 10 nM, such as less than 500 pM.

In another preferred, but non-limiting aspect, the invention relates to a Nanobody as described above, in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 394-399. This degree of amino acid identity can for example be determined by determining the degree of amino acid identity (in a manner described herein) between said Nanobody and one or more of the sequences of SEQ ID NO's: 394-399, in which the amino acid residues that form the framework regions are disregarded. Such Nanobodies can be as further described herein.

As already mentioned herein, another preferred but non-limiting aspect of the invention relates to a Nanobody with an amino acid sequence that is chosen from the group consisting of SEQ ID NO's: 394-399 or from the group consisting of from amino acid sequences that have more than 80%, preferably more than 90%, more preferably more than 95%, such as 99% or more sequence identity (as defined herein) with at least one of the amino acid sequences of SEQ ID NO's: 394-399.

Also, in the above Nanobodies:
i) any amino acid substitution (when it is not a humanizing substitution as defined herein) is preferably, and compared to the corresponding amino acid sequence of SEQ ID NO's: 394-399, a conservative amino acid substitution, (as defined herein);
and/or:
ii) its amino acid sequence preferably contains either only amino acid substitutions, or otherwise preferably no more than 5, preferably no more than 3, and more preferably only 1 or 2 amino acid deletions or insertions, compared to the corresponding amino acid sequence of SEQ ID NO's: 394-399;
and/or
iii) the CDR's may be CDR's that are derived by means of affinity maturation, for example starting from the CDR's of to the corresponding amino acid sequence of SEQ ID NO's: 394-399.

Preferably, the CDR sequences and FR sequences in the Nanobodies of the invention are such that the Nanobodies of the invention (and polypeptides of the invention comprising the same):
bind to PD-L1 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);
and/or such that they:
bind to PD-L1 with a $k_{on}$-rate of between $10^2$ $M^{-1}$ $s^{-1}$ to about $10^7$ $M^{-1}$ $s^{-1}$, preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$;
and/or such that they:
bind to PD-L1 with a $k_{off}$-rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, CDR sequences and FR sequences present in the Nanobodies of the invention are such that the Nanobodies of the invention will bind to PD-L1 with an affinity less than 500 nM, preferably less than 200 nM, more preferably less than 10 nM, such as less than 500 pM.

In another preferred, but non-limiting aspect, the invention relates to a Nanobody as described above, in which the CDR sequences have at least 70% amino acid identity, preferably at least 80% amino acid identity, more preferably at least 90% amino acid identity, such as 95% amino acid identity or more or even essentially 100% amino acid identity with CDR sequences of at least one of the amino acid sequences of SEQ ID NO's: 449-455. This degree of amino acid identity can for example be determined by determining the degree of amino acid identity (in a manner described herein) between said Nanobody and one or more of the sequences of SEQ ID NO's: 449-455, in which the amino acid residues that form the framework regions are disregarded. Such Nanobodies can be as further described herein.

As already mentioned herein, another preferred but non-limiting aspect of the invention relates to a Nanobody with an amino acid sequence that is chosen from the group consisting of SEQ ID NO's: 449-455 or from the group consisting of from amino acid sequences that have more than 80%, preferably more than 90%, more preferably more than 95%, such as 99% or more sequence identity (as defined herein) with at least one of the amino acid sequences of SEQ ID NO's: 449-455.

Also, in the above Nanobodies:
i) any amino acid substitution (when it is not a humanizing substitution as defined herein) is preferably, and compared to the corresponding amino acid sequence of SEQ ID NO's: 449-455, a conservative amino acid substitution, (as defined herein);
and/or:
ii) its amino acid sequence preferably contains either only amino acid substitutions, or otherwise preferably no more than 5, preferably no more than 3, and more preferably only 1 or 2 amino acid deletions or insertions, compared to the corresponding amino acid sequence of SEQ ID NO's: 449-455;
and/or
iii) the CDR's may be CDR's that are derived by means of affinity maturation, for example starting from the CDR's of to the corresponding amino acid sequence of SEQ ID NO's: 449-455.

Preferably, the CDR sequences and FR sequences in the Nanobodies of the invention are such that the Nanobodies of the invention (and polypeptides of the invention comprising the same):
bind to PD-L2 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);
and/or such that they:
bind to PD-L2 with a $k_{on}$-rate of between $10^2$ $M^{-1}$ $s^{-1}$ to about $10^7$ $M^{-1}$ $s^{-1}$, preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$;
and/or such that they:
bind to PD-L2 with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, CDR sequences and FR sequences present in the Nanobodies of the invention are such that the Nanobodies of the invention will bind to PD-L2 with an affinity less than 500 nM, preferably less than 200 nM, more preferably less than 10 nM, such as less than 500 pM.

In another preferred, but non-limiting aspect, the invention relates to a Nanobody as described above, in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 505-511. This degree of amino acid identity can for example be determined by determining the degree of amino acid identity (in a manner described herein) between said Nanobody and one or more of the sequences of SEQ ID NO's: 505-511, in which the amino acid residues that form the framework regions are disregarded. Such Nanobodies can be as further described herein.

As already mentioned herein, another preferred but non-limiting aspect of the invention relates to a Nanobody with an amino acid sequence that is chosen from the group consisting of SEQ ID NO's: 505-511 or from the group consisting of from amino acid sequences that have more than 80%, preferably more than 90%, more preferably more than 95%, such as 99% or more sequence identity (as defined herein) with at least one of the amino acid sequences of SEQ ID NO's: 505-511.

Also, in the above Nanobodies:
i) any amino acid substitution (when it is not a humanizing substitution as defined herein) is preferably, and compared to the corresponding amino acid sequence of SEQ ID NO's: 505-511, a conservative amino acid substitution, (as defined herein);
and/or:
ii) its amino acid sequence preferably contains either only amino acid substitutions, or otherwise preferably no more than 5, preferably no more than 3, and more preferably only 1 or 2 amino acid deletions or insertions, compared to the corresponding amino acid sequence of SEQ ID NO's: 505-511;
and/or
iii) the CDR's may be CDR's that are derived by means of affinity maturation, for example starting from the CDR's of to the corresponding amino acid sequence of SEQ ID NO's: 505-511.

Preferably, the CDR sequences and FR sequences in the Nanobodies of the invention are such that the Nanobodies of the invention (and polypeptides of the invention comprising the same):
bind to ICOSL with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);
and/or such that they:
bind to ICOSL with a $k_{on}$-rate of between $10^2$ $M^{-1}$ $s^{-1}$ to about $10^7$ $M^{-1}$ $s^{-1}$, preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$;
and/or such that they:
bind to ICOSL with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, CDR sequences and FR sequences present in the Nanobodies of the invention are such that the Nanobodies of the invention will bind to ICOSL with an affinity less than 500 nM, preferably less than 200 nM, more preferably less than 10 nM, such as less than 500 pM.

In another preferred, but non-limiting aspect, the invention relates to a Nanobody as described above, in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 554-559. This degree of amino acid identity can for example be determined by determining the degree of amino acid identity (in a manner described herein) between said Nanobody and one or more of the sequences of SEQ ID NO's: 554-559, in which the amino acid residues that form the framework regions are disregarded. Such Nanobodies can be as further described herein.

As already mentioned herein, another preferred but non-limiting aspect of the invention relates to a Nanobody with an amino acid sequence that is chosen from the group consisting of SEQ ID NO's: 554-559 or from the group consisting of from amino acid sequences that have more than 80%, preferably more than 90%, more preferably more than 95%, such as 99% or more sequence identity (as defined herein) with at least one of the amino acid sequences of SEQ ID NO's: 554-559.

Also, in the above Nanobodies:

any amino acid substitution (when it is not a humanizing substitution as defined herein) is preferably, and compared to the corresponding amino acid sequence of SEQ ID NO's: 554-559, a conservative amino acid substitution, (as defined herein);

and/or:

its amino acid sequence preferably contains either only amino acid substitutions, or otherwise preferably no more than 5, preferably no more than 3, and more preferably only 1 or 2 amino acid deletions or insertions, compared to the corresponding amino acid sequence of SEQ ID NO's: 554-559;

and/or the CDR's may be CDR's that are derived by means of affinity maturation, for example starting from the CDR's of to the corresponding amino acid sequence of SEQ ID NO's: 554-559.

Preferably, the CDR sequences and FR sequences in the Nanobodies of the invention are such that the Nanobodies of the invention (and polypeptides of the invention comprising the same):

bind to CD28 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to CD28 with a $k_{on}$-rate of between $10^2$ $M^{-1}$ $s^{-1}$ to about $10^7$ $M^{-1}$ $s^{-1}$, preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$;

and/or such that they:

bind to CD28 with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, CDR sequences and FR sequences present in the Nanobodies of the invention are such that the Nanobodies of the invention will bind to CD28 with an affinity less than 500 nM, preferably less than 200 nM, more preferably less than 10 nM, such as less than 500 pM.

In another preferred, but non-limiting aspect, the invention relates to a Nanobody as described above, in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 1288-1391. This degree of amino acid identity can for example be determined by determining the degree of amino acid identity (in a manner described herein) between said Nanobody and one or more of the sequences of SEQ ID NO's: 1288-1391, in which the amino acid residues that form the framework regions are disregarded. Such Nanobodies can be as further described herein.

As already mentioned herein, another preferred but non-limiting aspect of the invention relates to a Nanobody with an amino acid sequence that is chosen from the group consisting of SEQ ID NO's: 1288-1391 or from the group consisting of from amino acid sequences that have more than 80%, preferably more than 90%, more preferably more than 95%, such as 99% or more sequence identity (as defined herein) with at least one of the amino acid sequences of SEQ ID NO's: 1288-1391.

Also, in the above Nanobodies:

any amino acid substitution (when it is not a humanizing substitution as defined herein) is preferably, and compared to the corresponding amino acid sequence of SEQ ID NO's: 1288-1391, a conservative amino acid substitution, (as defined herein);

and/or:

its amino acid sequence preferably contains either only amino acid substitutions, or otherwise preferably no more than 5, preferably no more than 3, and more preferably only 1 or 2 amino acid deletions or insertions, compared to the corresponding amino acid sequence of SEQ ID NO's: 1288-1391;

and/or the CDR's may be CDR's that are derived by means of affinity maturation, for example starting from the CDR's of to the corresponding amino acid sequence of SEQ ID NO's: 1288-1391.

Preferably, the CDR sequences and FR sequences in the Nanobodies of the invention are such that the Nanobodies of the invention (and polypeptides of the invention comprising the same):

bind to CTLA4 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to CTLA4 with a $k_{on}$-rate of between $10^2$ $M^{-1}$ $s^{-1}$ to about $10^7$ $M^{-1}$ $s^{-1}$, preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$;

and/or such that they:

bind to CTLA4 with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, CDR sequences and FR sequences present in the Nanobodies of the invention are such that the Nanobodies of the invention will bind to ICOSL with an affinity less than 500 nM, preferably less than 200 nM, more preferably less than 10 nM, such as less than 500 pM.

According to one non-limiting aspect of the invention, a Nanobody may be as defined herein, but with the proviso that it has at least "one amino acid difference" (as defined herein) in at least one of the framework regions compared to the corresponding framework region of a naturally occurring human $V_H$ domain, and in particular compared to the corresponding framework region of DP-47. More specifically, according to one non-limiting aspect of the invention, a Nanobody may be as defined herein, but with the proviso that it has at least "one amino acid difference" (as defined herein) at least one of the Hallmark residues (including those at positions 108, 103 and/or 45) compared to the corresponding framework region of a naturally occurring human $V_H$ domain, and in particular compared to the corresponding framework region of DP-47. Usually, a Nanobody will have at least one such amino acid difference with a naturally occurring $V_H$ domain in at least one of FR2 and/or FR4, and in particular at least one of the Hallmark residues in FR2 and/or FR4 (again, including those at positions 108, 103 and/or 45).

Also, a humanized Nanobody of the invention may be as defined herein, but with the proviso that it has at least "one amino acid difference" (as defined herein) in at least one of the framework regions compared to the corresponding framework region of a naturally occurring $V_{HH}$ domain. More specifically, according to one non-limiting aspect of the invention, a humanized Nanobody may be as defined herein, but with the proviso that it has at least "one amino acid difference" (as defined herein) at least one of the Hallmark residues (including those at positions 108, 103 and/or 45) compared to the corresponding framework region of a naturally occurring $V_{HH}$ domain. Usually, a humanized Nanobody will have at least one such amino acid difference with a naturally occurring $V_{HH}$ domain in at least one of FR2 and/or FR4, and in particular at least one of the Hallmark residues in FR2 and/or FR4 (again, including those at positions 108, 103 and/or 45).

As will be clear from the disclosure herein, it is also within the scope of the invention to use natural or synthetic analogs, mutants, variants, alleles, homologs and orthologs (herein collectively referred to as "analogs") of the Nanobodies of the invention as defined herein, and in particular analogs of the Nanobodies of SEQ ID NO's 266-285, SEQ ID NO's: 347-351, SEQ ID NO's: 394-399, SEQ ID NO's: 449-455, SEQ ID NO's: 505-511, SEQ ID NO's: 554-559 and SEQ ID NO's: 1288-1391. Thus, according to one aspect of the invention, the term "Nanobody of the invention" in its broadest sense also covers such analogs.

Generally, in such analogs, one or more amino acid residues may have been replaced, deleted and/or added, compared to the Nanobodies of the invention as defined herein. Such substitutions, insertions or deletions may be made in one or more of the framework regions and/or in one or more of the CDR's. When such substitutions, insertions or deletions are made in one or more of the framework regions, they may be made at one or more of the Hallmark residues and/or at one or more of the other positions in the framework residues, although substitutions, insertions or deletions at the Hallmark residues are generally less preferred (unless these are suitable humanizing substitutions as described herein).

By means of non-limiting examples, a substitution may for example be a conservative substitution (as described herein) and/or an amino acid residue may be replaced by another amino acid residue that naturally occurs at the same position in another $V_{HH}$ domain (see Tables A-5 to A-8 for some non-limiting examples of such substitutions), although the invention is generally not limited thereto. Thus, any one or more substitutions, deletions or insertions, or any combination thereof, that either improve the properties of the Nanobody of the invention or that at least do not detract too much from the desired properties or from the balance or combination of desired properties of the Nanobody of the invention (i.e. to the extent that the Nanobody is no longer suited for its intended use) are included within the scope of the invention. A skilled person will generally be able to determine and select suitable substitutions, deletions or insertions, or suitable combinations of thereof, based on the disclosure herein and optionally after a limited degree of routine experimentation, which may for example involve introducing a limited number of possible substitutions and determining their influence on the properties of the Nanobodies thus obtained.

For example, and depending on the host organism used to express the Nanobody or polypeptide of the invention, such deletions and/or substitutions may be designed in such a way that one or more sites for post-translational modification (such as one or more glycosylation sites) are removed, as will be within the ability of the person skilled in the art. Alternatively, substitutions or insertions may be designed so as to introduce one or more sites for attachment of functional groups (as described herein), for example to allow site-specific pegylation (again as described herein).

As can be seen from the data on the $V_{HH}$ entropy and $V_{HH}$ variability given in Tables A-5 to A-8 above, some amino acid residues in the framework regions are more conserved than others. Generally, although the invention in its broadest sense is not limited thereto, any substitutions, deletions or insertions are preferably made at positions that are less conserved. Also, generally, amino acid substitutions are preferred over amino acid deletions or insertions.

The analogs are preferably such that they can bind to the APC target or T-cell target with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein for the Nanobodies of the invention.

The analogs are preferably also such that they retain the favourable properties the Nanobodies, as described herein.

Also, according to one preferred aspect, the analogs have a degree of sequence identity of at least 70%, preferably at least 80%, more preferably at least 90%, such as at least 95% or 99% or more; and/or preferably have at most 20, preferably at most 10, even more preferably at most 5, such as 4, 3, 2 or only 1 amino acid difference (as defined herein), with one of the Nanobodies of SEQ ID NOs: 266-285, SEQ ID NO's: 347-351, SEQ ID NO's: 394-399, SEQ ID NO's: 449-455, SEQ ID NO's: 505-511, SEQ ID NO's: 554-559 and SEQ ID NO's: 1288-1391.

Also, the framework sequences and CDR's of the analogs are preferably such that they are in accordance with the preferred aspects defined herein. More generally, as described herein, the analogs will have (a) a Q at position 108; and/or (b) a charged amino acid or a cysteine residue at position 45 and preferably an E at position 44, and more preferably E at position 44 and R at position 45; and/or (c) P, R or S at position 103.

One preferred class of analogs of the Nanobodies of the invention comprise Nanobodies that have been humanized (i.e. compared to the sequence of a naturally occurring Nanobody of the invention). As mentioned in the background art cited herein, such humanization generally involves replacing one or more amino acid residues in the sequence of a naturally occurring $V_{HH}$ with the amino acid residues that occur at the same position in a human $V_H$ domain, such as a human $V_H3$ domain. Examples of possible humanizing substitutions or combinations of humanizing substitutions will be clear to the skilled person, for example from the Tables herein, from the possible humanizing substitutions mentioned in the background art cited herein, and/or from a comparison between the sequence of a Nanobody and the sequence of a naturally occurring human $V_H$ domain.

The humanizing substitutions should be chosen such that the resulting humanized Nanobodies still retain the favourable properties of Nanobodies as defined herein, and more preferably such that they are as described for analogs in the preceding paragraphs. A skilled person will generally be able to determine and select suitable humanizing substitutions or suitable combinations of humanizing substitutions, based on the disclosure herein and optionally after a limited degree of routine experimentation, which may for example involve introducing a limited number of possible humanizing substitutions and determining their influence on the properties of the Nanobodies thus obtained.

Generally, as a result of humanization, the Nanobodies of the invention may become more "human-like", while still retaining the favorable properties of the Nanobodies of the invention as described herein. As a result, such humanized Nanobodies may have several advantages, such as a reduced immunogenicity, compared to the corresponding naturally occurring $V_{HH}$ domains. Again, based on the disclosure herein and optionally after a limited degree of routine experimentation, the skilled person will be able to select humanizing substitutions or suitable combinations of humanizing substitutions which optimize or achieve a desired or suitable balance between the favourable properties provided by the humanizing substitutions on the one hand and the favourable properties of naturally occurring $V_{HH}$ domains on the other hand.

The Nanobodies of the invention may be suitably humanized at any framework residue(s), such as at one or more Hallmark residues (as defined herein) or at one or more other framework residues (i.e. non-Hallmark residues) or any suitable combination thereof. One preferred humanizing substitution for Nanobodies of the "P, R, S-103 group" or the "KERE group" is Q108 into L108. Nanobodies of the "GLEW class" may also be humanized by a Q108 into L108 substitution, provided at least one of the other Hallmark residues contains a camelid (camelizing) substitution (as defined herein). For example, as mentioned above, one particularly preferred class of humanized Nanobodies has GLEW or a GLEW-like sequence at positions 44-47; P, R or S (and in particular R) at position 103, and an L at position 108.

The humanized and other analogs, and nucleic acid sequences encoding the same, can be provided in any manner known per se. For example, the analogs can be obtained by providing a nucleic acid that encodes a naturally occurring $V_{HH}$ domain, changing the codons for the one or more amino acid residues that are to be substituted into the codons for the corresponding desired amino acid residues (e.g. by site-directed mutagenesis or by PCR using suitable mismatch primers), expressing the nucleic acid/nucleotide sequence thus obtained in a suitable host or expression system; and optionally isolating and/or purifying the analog thus obtained to provide said analog in essentially isolated form (e.g. as further described herein). This can generally be performed using methods and techniques known per se, which will be clear to the skilled person, for example from the handbooks and references cited herein, the background art cited herein and/or from the further description herein. Alternatively, a nucleic acid encoding the desired analog can be synthesized in a manner known per se (for example using an automated apparatus for synthesizing nucleic acid sequences with a predefined amino acid sequence) and can then be expressed as described herein. Yet another technique may involve combining one or more naturally occurring and/or synthetic nucleic acid sequences each encoding a part of the desired analog, and then expressing the combined nucleic acid sequence as described herein. Also, the analogs can be provided using chemical synthesis of the pertinent amino acid sequence using techniques for peptide synthesis known per se, such as those mentioned herein.

In this respect, it will be also be clear to the skilled person that the Nanobodies of the invention (including their analogs) can be designed and/or prepared starting from human $V_H$ sequences (i.e. amino acid sequences or the corresponding nucleotide sequences), such as for example from human $V_H3$ sequences such as DP-47, DP-51 or DP-29, i.e. by introducing one or more camelizing substitutions (i.e. changing one or more amino acid residues in the amino acid sequence of said human $V_H$ domain into the amino acid residues that occur at the corresponding position in a $V_{HH}$ domain), so as to provide the sequence of a Nanobody of the invention and/or so as to confer the favourable properties of a Nanobody to the sequence thus obtained. Again, this can generally be performed using the various methods and techniques referred to in the previous paragraph, using an amino acid sequence and/or nucleotide sequence for a human $V_H$ domain as a starting point.

Some preferred, but non-limiting camelizing substitutions can be derived from Tables A-5-A-8. It will also be clear that camelizing substitutions at one or more of the Hallmark residues will generally have a greater influence on the desired properties than substitutions at one or more of the other amino acid positions, although both and any suitable combination thereof are included within the scope of the invention. For example, it is possible to introduce one or more camelizing substitutions that already confer at least some the desired properties, and then to introduce further camelizing substitutions that either further improve said properties and/or confer additional favourable properties. Again, the skilled person will generally be able to determine and select suitable camelizing substitutions or suitable combinations of camelizing substitutions, based on the disclosure herein and optionally after a limited degree of routine experimentation, which may for example involve introducing a limited number of possible camelizing substitutions and determining whether the favourable properties of Nanobodies are obtained or improved (i.e. compared to the original $V_H$ domain).

Generally, however, such camelizing substitutions are preferably such that the resulting an amino acid sequence at least contains (a) a Q at position 108; and/or (b) a charged amino acid or a cysteine residue at position 45 and preferably also an E at position 44, and more preferably E at position 44 and R at position 45; and/or (c) P, R or S at position 103; and optionally one or more further camelizing substitutions. More preferably, the camelizing substitutions are such that they result in a Nanobody of the invention and/or in an analog thereof (as defined herein), such as in a humanized analog and/or preferably in an analog that is as defined in the preceding paragraphs.

As will also be clear from the disclosure herein, it is also within the scope of the invention to use parts or fragments, or combinations of two or more parts or fragments, of the Nanobodies of the invention as defined herein, and in particular parts or fragments of the Nanobodies of SEQ ID NO's: 266-285, SEQ ID NO's: 347-351, SEQ ID NO's: 394-399, SEQ ID NO's: 449-455, SEQ ID NO's: 505-511, SEQ ID NO's: 554-559 and SEQ ID NO's: 1288-1391. Thus, according to one aspect of the invention, the term "Nanobody of the invention" in its broadest sense also covers such parts or fragments.

Generally, such parts or fragments of the Nanobodies of the invention (including analogs thereof) have amino acid sequences in which, compared to the amino acid sequence of the corresponding full length Nanobody of the invention (or analog thereof), one or more of the amino acid residues at the N-terminal end, one or more amino acid residues at the C-terminal end, one or more contiguous internal amino acid residues, or any combination thereof, have been deleted and/or removed.

The parts or fragments are preferably such that they can bind to the APC target or T-cell target with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein for the Nanobodies of the invention.

Any part or fragment is preferably such that it comprises at least 10 contiguous amino acid residues, preferably at least 20 contiguous amino acid residues, more preferably at least 30 contiguous amino acid residues, such as at least 40 contiguous amino acid residues, of the amino acid sequence of the corresponding full length Nanobody of the invention.

Also, any part or fragment is such preferably that it comprises at least one of CDR1, CDR2 and/or CDR3 or at least part thereof (and in particular at least CDR3 or at least part thereof). More preferably, any part or fragment is such that it comprises at least one of the CDR's (and preferably at least CDR3 or part thereof) and at least one other CDR (i.e. CDR1 or CDR2) or at least part thereof, preferably connected by suitable framework sequence(s) or at least part thereof. More preferably, any part or fragment is such that it comprises at least one of the CDR's (and preferably at least CDR3 or part thereof) and at least part of the two remaining CDR's, again preferably connected by suitable framework sequence(s) or at least part thereof.

According to another particularly preferred, but non-limiting aspect, such a part or fragment comprises at least CDR3, such as FR3, CDR3 and FR4 of the corresponding full length Nanobody of the invention, i.e. as for example described in the International application WO 03/050531 (Lasters et al.).

As already mentioned above, it is also possible to combine two or more of such parts or fragments (i.e. from the same or different Nanobodies of the invention), i.e. to provide an analog (as defined herein) and/or to provide further parts or fragments (as defined herein) of a Nanobody of the invention. It is for example also possible to combine one or more parts or fragments of a Nanobody of the invention with one or more parts or fragments of a human $V_H$ domain.

According to one preferred aspect, the parts or fragments have a degree of sequence identity of at least 50%, preferably at least 60%, more preferably at least 70%, even more preferably at least 80%, such as at least 90%, 95% or 99% or more with one of the Nanobodies of SEQ ID NOs 266-285, SEQ ID NO's: 347-351, SEQ ID NO's: 394-399, SEQ ID NO's: 449-455, SEQ ID NO's: 505-511, SEQ ID NO's: 554-559 and SEQ ID NO's: 1288-1391.

The parts and fragments, and nucleic acid sequences encoding the same, can be provided and optionally combined in any manner known per se. For example, such parts or fragments can be obtained by inserting a stop codon in a nucleic acid that encodes a full-sized Nanobody of the invention, and then expressing the nucleic acid thus obtained in a manner known per se (e.g. as described herein). Alternatively, nucleic acids encoding such parts or fragments can be obtained by suitably restricting a nucleic acid that encodes a full-sized Nanobody of the invention or by synthesizing such a nucleic acid in a manner known per se. Parts or fragments may also be provided using techniques for peptide synthesis known per se.

The invention in its broadest sense also comprises derivatives of the Nanobodies of the invention. Such derivatives can generally be obtained by modification, and in particular by chemical and/or biological (e.g enzymatical) modification, of the Nanobodies of the invention and/or of one or more of the amino acid residues that form the Nanobodies of the invention.

Examples of such modifications, as well as examples of amino acid residues within the Nanobody sequence that can be modified in such a manner (i.e. either on the protein backbone but preferably on a side chain), methods and techniques that can be used to introduce such modifications and the potential uses and advantages of such modifications will be clear to the skilled person.

For example, such a modification may involve the introduction (e.g. by covalent linking or in an other suitable manner) of one or more functional groups, residues or moieties into or onto the Nanobody of the invention, and in particular of one or more functional groups, residues or moieties that confer one or more desired properties or functionalities to the Nanobody of the invention. Example of such functional groups will be clear to the skilled person.

For example, such modification may comprise the introduction (e.g. by covalent binding or in any other suitable manner) of one or more functional groups that increase the half-life, the solubility and/or the absorption of the Nanobody of the invention, that reduce the immunogenicity and/or the toxicity of the Nanobody of the invention, that eliminate or attenuate any undesirable side effects of the Nanobody of the invention, and/or that confer other advantageous properties to and/or reduce the undesired properties of the Nanobodies and/or polypeptides of the invention; or any combination of two or more of the foregoing. Examples of such functional groups and of techniques for introducing them will be clear to the skilled person, and can generally comprise all functional groups and techniques mentioned in the general background art cited hereinabove as well as the functional groups and techniques known per se for the modification of pharmaceutical proteins, and in particular for the modification of antibodies or antibody fragments (including ScFv's and single domain antibodies), for which reference is for example made to Remington's Pharmaceutical Sciences, 16th ed., Mack Publishing Co., Easton, Pa. (1980). Such functional groups may for example be linked directly (for example covalently) to a Nanobody of the invention, or optionally via a suitable linker or spacer, as will again be clear to the skilled person.

One of the most widely used techniques for increasing the half-life and/or reducing the immunogenicity of pharmaceutical proteins comprises attachment of a suitable pharmacologically acceptable polymer, such as poly(ethyleneglycol) (PEG) or derivatives thereof (such as methoxypoly(ethyleneglycol) or MPEG). Generally, any suitable form of pegylation can be used, such as the pegylation used in the art for antibodies and antibody fragments (including but not limited to (single) domain antibodies and ScFv's); reference is made to for example Chapman, Nat. Biotechnol., 54, 531-545 (2002); by Veronese and Harris, Adv. Drug Deliv. Rev. 54, 453-456 (2003), by Harris and Chess, Nat. Rev. Drug. Discov., 2, (2003) and in WO 04/060965. Various reagents for pegylation of proteins are also commercially available, for example from Nektar Therapeutics, USA.

Preferably, site-directed pegylation is used, in particular via a cysteine-residue (see for example Yang et al., Protein Engineering, 16, 10, 761-770 (2003). For example, for this purpose, PEG may be attached to a cysteine residue that naturally occurs in a Nanobody of the invention, a Nanobody of the invention may be modified so as to suitably introduce one or more cysteine residues for attachment of PEG, or an amino acid sequence comprising one or more cysteine residues for attachment of PEG may be fused to the N- and/or C-terminus of a Nanobody of the invention, all using techniques of protein engineering known per se to the skilled person.

Preferably, for the Nanobodies and proteins of the invention, a PEG is used with a molecular weight of more than 5000, such as more than 10,000 and less than 200,000, such as less than 100,000; for example in the range of 20,000-80,000.

Another, usually less preferred modification comprises N-linked or O-linked glycosylation, usually as part of co-translational and/or post-translational modification, depending on the host cell used for expressing the Nanobody or polypeptide of the invention.

Yet another modification may comprise the introduction of one or more detectable labels or other signal-generating groups or moieties, depending on the intended use of the labelled Nanobody. Suitable labels and techniques for attaching, using and detecting them will be clear to the skilled person, and for example include, but are not limited to, fluorescent labels (such as fluorescein, isothiocyanate, rhodamine, phycoerythrin, phycocyanin, allophycocyanin, o-phthaldehyde, and fluorescamine and fluorescent metals such as $^{152}$Eu or others metals from the lanthanide series), phosphorescent labels, chemiluminescent labels or bioluminescent labels (such as luminal, isoluminol, theromatic acridinium ester, imidazole, acridinium salts, oxalate ester, dioxetane or GFP and its analogs), radio-isotopes (such as $^3$H, $^{125}$I, $^{32}$P, $^{35}$S, $^{14}$C, $^{51}$Cr, $^{36}$Cl, $^{57}$Co, $^{58}$Co, $^{59}$Fe, and $^{75}$Se), metals, metal chelates or metallic cations (for example metallic cations such as $^{99m}$Tc, $^{123}$I, $^{111}$In, $^{131}$I, $^{97}$Ru, $^{67}$Cu, $^{67}$Ga, and $^{68}$Ga or other metals or metallic cations that are particularly suited for use in in vivo, in vitro or in situ diagnosis and imaging, such as ($^{157}$Gd, $^{55}$Mn, $^{162}$Dy, $^{52}$Cr, and $^{56}$Fe), as well as chromophores and enzymes (such as malate dehydrogenase, staphylococcal nuclease, delta-V-steroid isomerase, yeast alcohol dehydrogenase, alpha-glycerophosphate dehydrogenase, triose phosphate isomerase, biotinavidin peroxidase, horseradish peroxidase, alkaline phosphatase, asparaginase, glucose oxidase, beta-galactosidase, ribonuclease, urease, catalase, glucose-VI-phosphate dehydrogenase, glucoamylase and acetylcholine esterase). Other suitable labels will be clear to the skilled person, and for example include moieties that can be detected using NMR or ESR spectroscopy.

Such labelled Nanobodies and polypeptides of the invention may for example be used for in vitro, in vivo or in situ assays (including immunoassays known per se such as ELISA, RIA, EIA and other "sandwich assays", etc.) as well as in vivo diagnostic and imaging purposes, depending on the choice of the specific label.

As will be clear to the skilled person, another modification may involve the introduction of a chelating group, for example to chelate one of the metals or metallic cations referred to above. Suitable chelating groups for example include, without limitation, diethylenetriaminepentaacetic acid (DTPA) or ethylenediaminetetraacetic acid (EDTA).

Yet another modification may comprise the introduction of a functional group that is one part of a specific binding pair, such as the biotin-(strept)avidin binding pair. Such a functional group may be used to link the Nanobody of the invention to another protein, polypeptide or chemical compound that is bound to the other half of the binding pair, i.e. through formation of the binding pair. For example, a Nanobody of the invention may be conjugated to biotin, and linked to another protein, polypeptide, compound or carrier conjugated to avidin or streptavidin. For example, such a conjugated Nanobody may be used as a reporter, for example in a diagnostic system where a detectable signal-producing agent is conjugated to avidin or streptavidin. Such binding pairs may for example also be used to bind the Nanobody of the invention to a carrier, including carriers suitable for pharmaceutical purposes. One non-limiting example are the liposomal formulations described by Cao and Suresh, Journal of Drug Targeting, 8, 4, 257 (2000). Such binding pairs may also be used to link a therapeutically active agent to the Nanobody of the invention.

For some applications, in particular for those applications in which it is intended to kill a cell that expresses the target against which the Nanobodies of the invention are directed (e.g. in the treatment of cancer), or to reduce or slow the growth and/or proliferation such a cell, the Nanobodies of the invention may also be linked to a toxin or to a toxic residue or moiety. Examples of toxic moieties, compounds or residues which can be linked to a Nanobody of the invention to provide—for example—a cytotoxic compound will be clear to the skilled person and can for example be found in the prior art cited above and/or in the further description herein. One example is the so-called ADEPT™ technology described in WO 03/055527.

Other potential chemical and enzymatical modifications will be clear to the skilled person. Such modifications may also be introduced for research purposes (e.g. to study function-activity relationships). Reference is for example made to Lundblad and Bradshaw, Biotechnol. Appl. Biochem., 26, 143-151 (1997).

Preferably, the derivatives are such that they bind to the APC target or T-cell target with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein for the Nanobodies of the invention.

As mentioned above, the invention also relates to proteins or polypeptides that essentially consist of or comprise at least one Nanobody of the invention. By "essentially consist of" is meant that the amino acid sequence of the polypeptide of the invention either is exactly the same as the amino acid sequence of a Nanobody of the invention or corresponds to the amino acid sequence of a Nanobody of the invention which has a limited number of amino acid residues, such as 1-20 amino acid residues, for example 1-10 amino acid residues and preferably 1-6 amino acid residues, such as 1, 2, 3, 4, 5 or 6 amino acid residues, added at the amino terminal end, at the carboxy terminal end, or at both the amino terminal end and the carboxy terminal end of the amino acid sequence of the Nanobody.

Said amino acid residues may or may not change, alter or otherwise influence the (biological) properties of the Nanobody and may or may not add further functionality to the Nanobody. For example, such amino acid residues:

can comprise an N-terminal Met residue, for example as result of expression in a heterologous host cell or host organism.

may form a signal sequence or leader sequence that directs secretion of the Nanobody from a host cell upon synthesis. Suitable secretory leader peptides will be clear to the skilled person, and may be as further described herein. Usually, such a leader sequence will be linked to the N-terminus of the Nanobody, although the invention in its broadest sense is not limited thereto;

may form a sequence or signal that allows the Nanobody to be directed towards and/or to penetrate or enter into specific organs, tissues, cells, or parts or compartments of cells, and/or that allows the Nanobody to penetrate or cross a biological barrier such as a cell membrane, a cell layer such as a layer of epithelial cells, a tumor including solid tumors, or the blood-brain-barrier. Examples of such amino acid sequences will be clear to the skilled person. Some non-limiting examples are the small peptide vectors ("Pep-trans vectors") described in WO 03/026700 and in Temsamani et al., Expert Opin. Biol. Ther., 1, 773 (2001); Temsamani and Vidal, Drug Discov. Today, 9, 1012 (004) and Rousselle, J. Pharmacol. Exp. Ther., 296, 124-131 (2001), and the membrane translocator sequence described by Zhao et al., Apoptosis, 8, 631-637 (2003). C-terminal and N-terminal amino acid sequences for intracellular targeting of antibody fragments are for example described by Cardinale et al., Methods, 34, 171 (2004). Other suitable techniques for intracellular targeting involve the expression and/or use of so-called "intrabodies" comprising a Nanobody of the invention, as mentioned below;

may form a "tag", for example an amino acid sequence or residue that allows or facilitates the purification of the Nanobody, for example using affinity techniques directed against said sequence or residue. Thereafter, said sequence or residue may be removed (e.g. by chemical or enzymatical cleavage) to provide the Nanobody sequence (for this purpose, the tag may optionally be linked to the Nanobody sequence via a cleavable linker sequence or contain a cleavable motif). Some preferred, but non-limiting examples of such residues are multiple histidine residues, glutatione residues and a myc-tag (see for example SEQ ID NO:31 of WO 06/12282).

may be one or more amino acid residues that have been functionalized and/or that can serve as a site for attachment of functional groups. Suitable amino acid residues and functional groups will be clear to the skilled person and include, but are not limited to, the amino acid residues and functional groups mentioned herein for the derivatives of the Nanobodies of the invention.

According to another aspect, a polypeptide of the invention comprises a Nanobody of the invention, which is fused at its amino terminal end, at its carboxy terminal end, or both at its amino terminal end and at its carboxy terminal end to at least one further amino acid sequence, i.e. so as to provide a fusion protein comprising said Nanobody of the invention and the one or more further amino acid sequences. Such a fusion will also be referred to herein as a "Nanobody fusion".

The one or more further amino acid sequence may be any suitable and/or desired amino acid sequences. The further amino acid sequences may or may not change, alter or otherwise influence the (biological) properties of the Nanobody, and may or may not add further functionality to the Nanobody or the polypeptide of the invention. Preferably, the further amino acid sequence is such that it confers one or more desired properties or functionalities to the Nanobody or the polypeptide of the invention.

For example, the further amino acid sequence may also provide a second binding site, which binding site may be directed against any desired protein, polypeptide, antigen, antigenic determinant or epitope (including but not limited to the same protein, polypeptide, antigen, antigenic determinant or epitope against which the Nanobody of the invention is directed, or a different protein, polypeptide, antigen, antigenic determinant or epitope).

Example of such amino acid sequences will be clear to the skilled person, and may generally comprise all amino acid sequences that are used in peptide fusions based on conventional antibodies and fragments thereof (including but not limited to ScFv's and single domain antibodies). Reference is for example made to the review by Holliger and Hudson, Nature Biotechnology, 23, 9, 1126-1136 (2005), For example, such an amino acid sequence may be an amino acid sequence that increases the half-life, the solubility, or the absorption, reduces the immunogenicity or the toxicity, eliminates or attenuates undesirable side effects, and/or confers other advantageous properties to and/or reduces the undesired properties of the polypeptides of the invention, compared to the Nanobody of the invention per se. Some non-limiting examples of such amino acid sequences are serum proteins, such as human serum albumin (see for example WO 00/27435) or haptenic molecules (for example haptens that are recognized by circulating antibodies, see for example WO 98/22141).

In particular, it has been described in the art that linking fragments of immunoglobulins (such as $V_H$ domains) to serum albumin or to fragments thereof can be used to increase the half-life. Reference is for made to WO 00/27435 and WO 01/077137). According to the invention, the Nanobody of the invention is preferably either directly linked to serum albumin (or to a suitable fragment thereof) or via a suitable linker, and in particular via a suitable peptide linked so that the polypeptide of the invention can be expressed as a genetic fusion (protein). Some preferred but non-limiting examples of Nanobodies linked to serum albumin are given in SEQ ID NOs: 1398-1399. According to one specific aspect, the Nanobody of the invention may be linked to a fragment of serum albumin that at least comprises the domain III of serum albumin or part thereof. Reference is for example made to the U.S. provisional application 60/788,256 of Ablynx N.V. entitled "Albumin derived amino acid sequence, use thereof for increasing the half-life of therapeutic proteins and of other therapeutic proteins and entities, and constructs comprising the same" filed on Mar. 31, 2006 (see also PCT/EP2007/002817).

Alternatively, the further amino acid sequence may provide a second binding site or binding unit that is directed against a serum protein (such as, for example, human serum albumin or another serum protein such as IgG), so as to provide increased half-life in serum. Such amino acid sequences for example include the Nanobodies described below, as well as the small peptides and binding proteins described in WO 91/01743, WO 01/45746 and WO 02/076489 and the dAb's described in WO 03/002609 and WO 04/003019. Reference is also made to Harmsen et al., Vaccine, 23 (41); 4926-42, 2005, as well as to EP 0 368 684, as well as to the following the U.S. provisional applications 60/843,349 (see also PCT/EP2007/059475), 60/850,774 (see also PCT/EP2007/060849), 60/850,775 (see also PCT/EP2007/060850) by Ablynx N.V. mentioned herein US provisional application of Ablynx N.V. entitled "Peptides capable of binding to serum proteins" filed on Dec. 5, 2006 (see also PCT/EP2007/063348).

Such amino acid sequences may in particular be directed against serum albumin (and more in particular human serum albumin) and/or against IgG (and more in particular human IgG). For example, such amino acid sequences may be amino acid sequences that are directed against (human) serum albumin and amino acid sequences that can bind to amino acid residues on (human) serum albumin that are not involved in binding of serum albumin to FcRn (see for example WO 06/0122787) and/or amino acid sequences that are capable of binding to amino acid residues on serum albumin that do not form part of domain III of serum albumin (see again for example WO 06/0122787); amino acid sequences that have or can provide an increased half-life (see for example the U.S. provisional application 60/843,349 by Ablynx N.V. entitled "Serum albumin binding proteins with long half-lives" filed on Sep. 8, 2006; see also PCT/EP2007/059475); amino acid sequences against human serum albumin that are cross-reactive with serum albumin from at least one species of mammal, and in particular with at least one species of primate (such as, without limitation, monkeys from the genus *Macaca* (such as, and in particular, cynomologus monkeys (*Macaca fascicularis*) and/or rhesus monkeys (*Macaca mulatta*)) and baboon (*Papio ursinus*), reference is again made to the U.S. provisional application 60/843,349 and PCT/EP2007/059475); amino acid sequences that can bind to serum albumin in a pH independent manner (see for example the U.S. provisional application 60/850,774 by Ablynx N.V. entitled "Amino acid sequences that bind to serum proteins in a manner that is essentially independent of the pH, compounds comprising the same, and uses thereof", filed on Oct. 11, 2006; see also and PCT/EP2007/059475) and/or amino acid sequences that are conditional binders (see for example the U.S. provisional application 60/850,775 by Ablynx N.V. entitled "Amino acid sequences that bind to a desired molecule in a conditional manner", filed on Oct. 11, 2006; see also PCT/EP2007/060850).

According to another aspect, the one or more further amino acid sequences may comprise one or more parts, fragments or domains of conventional 4-chain antibodies (and in particular human antibodies) and/or of heavy chain antibodies. For example, although usually less preferred, a Nanobody of the invention may be linked to a conventional (preferably human) $V_H$ or $V_L$ domain or to a natural or synthetic analog of a $V_H$ or $V_L$ domain, again optionally via a linker sequence (including but not limited to other (single) domain antibodies, such as the dAb's described by Ward et al.).

The at least one Nanobody may also be linked to one or more (preferably human) $C_H1$, $C_H2$ and/or $C_H3$ domains, optionally via a linker sequence. For instance, a Nanobody linked to a suitable $C_H1$ domain could for example be used—together with suitable light chains—to generate antibody fragments/structures analogous to conventional Fab fragments or F(ab')$_2$ fragments, but in which one or (in case of an F(ab')$_2$ fragment) one or both of the conventional $V_H$ domains have been replaced by a Nanobody of the invention. Also, two Nanobodies could be linked to a $C_H3$ domain (optionally via a linker) to provide a construct with increased half-life in vivo.

According to one specific aspect of a polypeptide of the invention, one or more Nanobodies of the invention may be linked (optionally via a suitable linker or hinge region) to one or more constant domains (for example, 2 or 3 constant domains that can be used as part of/to form an Fc portion), to an Fc portion and/or to one or more antibody parts, fragments or domains that confer one or more effector functions to the polypeptide of the invention and/or may confer the ability to bind to one or more Fc receptors. For example, for this purpose, and without being limited thereto, the one or more further amino acid sequences may comprise one or more $C_H2$ and/or $C_H3$ domains of an antibody, such as from a heavy chain antibody (as described herein) and more preferably from a conventional human 4-chain antibody; and/or may form (part of) and Fc region, for example from IgG (e.g. from IgG1, IgG2, IgG3 or IgG4), from IgE or from another human Ig such as IgA, IgD or IgM. For example, WO 94/04678 describes heavy chain antibodies comprising a Camelid $V_{HH}$ domain or a humanized derivative thereof (i.e. a Nanobody), in which the Camelidae $C_H2$ and/or $C_H3$ domain have been replaced by human $C_H2$ and $C_H3$ domains, so as to provide an immunoglobulin that consists of 2 heavy chains each comprising a Nanobody and human $C_H2$ and $C_H3$ domains (but no $C_H1$ domain), which immunoglobulin has the effector function provided by the $C_H2$ and $C_H3$ domains and which immunoglobulin can function without the presence of any light chains. Other amino acid sequences that can be suitably linked to the Nanobodies of the invention so as to provide an effector function will be clear to the skilled person, and may be chosen on the basis of the desired effector function(s). Reference is for example made to WO 04/058820, WO 99/42077, WO 02/056910 and WO 05/017148, as well as the review by Holliger and Hudson, supra; and to the non-prepublished US provisional application by Ablynx N.V. entitled "Constructs comprising single variable domains and an Fc portion derived from IgE" which has a filing date of Dec. 4, 2007. Coupling of a Nanobody of the invention to an Fc portion may also lead to an increased half-life, compared to the corresponding Nanobody of the invention. For some applications, the use of an Fc portion and/or of constant domains (i.e. $C_H2$ and/or $C_H3$ domains) that confer increased half-life without any biologically significant effector function may also be suitable or even preferred. Other suitable constructs comprising one or more Nanobodies and one or more constant domains with increased half-life in vivo will be clear to the skilled person, and may for example comprise two Nanobodies linked to a $C_H3$ domain, optionally via a linker sequence. Generally, any fusion protein or derivatives with increased half-life will preferably have a molecular weight of more than 50 kD, the cut-off value for renal absorption.

In another one specific, but non-limiting, aspect, in order to form a polypeptide of the invention, one or more amino acid sequences of the invention may be linked (optionally via a suitable linker or hinge region) to naturally occurring, synthetic or semisynthetic constant domains (or analogs, variants, mutants, parts or fragments thereof) that have a reduced (or essentially no) tendency to self-associate into dimers (i.e. compared to constant domains that naturally occur in conventional 4-chain antibodies). Such monomeric (i.e. not self-associating) Fc chain variants, or fragments thereof, will be clear to the skilled person. For example, Helm et al., J Biol Chem 1996 271 7494, describe monomeric Fcε chain variants that can be used in the polypeptide chains of the invention.

Also, such monomeric Fc chain variants are preferably such that they are still capable of binding to the complement or the relevant Fc receptor(s) (depending on the Fc portion from which they are derived), and/or such that they still have some or all of the effector functions of the Fc portion from which they are derived (or at a reduced level still suitable for the intended use). Alternatively, in such a polypeptide chain of the invention, the monomeric Fc chain may be used to confer increased half-life upon the polypeptide chain, in which case the monomeric Fc chain may also have no or essentially no effector functions.

Bivalent/multivalent, bispecific/multispecific or biparatopic/multiparatopic polypeptides of the invention may also be linked to Fc portions, in order to provide polypeptide constructs of the type that is described in the non-prepublished US provisional application entitled "immunoglobulin constructs" filed on Dec. 4, 2007.

The further amino acid sequences may also form a signal sequence or leader sequence that directs secretion of the Nanobody or the polypeptide of the invention from a host cell upon synthesis (for example to provide a pre-, pro- or preproform of the polypeptide of the invention, depending on the host cell used to express the polypeptide of the invention).

The further amino acid sequence may also form a sequence or signal that allows the Nanobody or polypeptide of the invention to be directed towards and/or to penetrate or enter into specific organs, tissues, cells, or parts or compartments of cells, and/or that allows the Nanobody or polypeptide of the invention to penetrate or cross a biological barrier such as a cell membrane, a cell layer such as a layer of epithelial cells, a tumor including solid tumors, or the blood-brain-barrier. Suitable examples of such amino acid sequences will be clear to the skilled person, and for example include, but are not limited to, the "Peptrans" vectors mentioned above, the sequences described by Cardinale et al. and the amino acid sequences and antibody fragments known per se that can be used to express or produce the Nanobodies and polypeptides of the invention as so-called "intrabodies", for example as described in WO 94/02610, WO 95/22618, U.S. Pat. No. 7,004,940, WO 03/014960, WO 99/07414; WO 05/01690; EP 1 512 696; and in Cattaneo, A. & Biocca, S. (1997) Intracellular Antibodies: Development and Applications. Landes and Springer-Verlag; and in Kontermann, Methods 34, (2004), 163-170, and the further references described therein.

For some applications, in particular for those applications in which it is intended to kill a cell that expresses the target against which the Nanobodies of the invention are directed (e.g. in the treatment of cancer), or to reduce or slow the growth and/or proliferation of such a cell, the Nanobodies of the invention may also be linked to a (cyto)toxic protein or polypeptide. Examples of such toxic proteins and polypeptides which can be linked to a Nanobody of the invention to provide—for example—a cytotoxic polypeptide of the invention will be clear to the skilled person and can for example be found in the prior art cited above and/or in the further description herein. One example is the so-called ADEPT™ technology described in WO 03/055527.

According to one preferred, but non-limiting aspect, said one or more further amino acid sequences comprise at least one further Nanobody, so as to provide a polypeptide of the invention that comprises at least two, such as three, four, five or more Nanobodies, in which said Nanobodies may optionally be linked via one or more linker sequences (as defined herein). Polypeptides of the invention that comprise two or more Nanobodies, of which at least one is a Nanobody of the invention, will also be referred to herein as "multivalent" polypeptides of the invention, and the Nanobodies present in such polypeptides will also be referred to as being in a "multivalent format". For example a "bivalent" polypeptide of the invention comprises two Nanobodies, optionally linked via a linker sequence, whereas a "trivalent" polypeptide of the invention comprises three Nanobodies, optionally linked via two linker sequences; etc.; in which at least one of the Nanobodies present in the polypeptide, and up to all of the Nanobodies present in the polypeptide, is/are a Nanobody of the invention.

In a multivalent polypeptide of the invention, the two or more Nanobodies may be the same or different, and may be directed against the same antigen or antigenic determinant (for example against the same part(s) or epitope(s) or against different parts or epitopes) or may alternatively be directed against different antigens or antigenic determinants; or any suitable combination thereof. For example, a bivalent polypeptide of the invention may comprise (a) two identical Nanobodies; (b) a first Nanobody directed against a first antigenic determinant of a protein or antigen and a second Nanobody directed against the same antigenic determinant of said protein or antigen which is different from the first Nanobody; (c) a first Nanobody directed against a first antigenic determinant of a protein or antigen and a second Nanobody directed against another antigenic determinant of said protein or antigen; or (d) a first Nanobody directed against a first protein or antigen and a second Nanobody directed against a second protein or antigen (i.e. different from said first antigen). Similarly, a trivalent polypeptide of the invention may, for example and without being limited thereto. comprise (a) three identical Nanobodies; (b) two identical Nanobody against a first antigenic determinant of an antigen and a third Nanobody directed against a different antigenic determinant of the same antigen; (c) two identical Nanobody against a first antigenic determinant of an antigen and a third Nanobody directed against a second antigen different from said first antigen; (d) a first Nanobody directed against a first antigenic determinant of a first antigen, a second Nanobody directed against a second antigenic determinant of said first antigen and a third Nanobody directed against a second antigen different from said first antigen; or (e) a first Nanobody directed against a first antigen, a second Nanobody directed against a second antigen different from said first antigen, and a third Nanobody directed against a third antigen different from said first and second antigen.

Polypeptides of the invention that contain at least two Nanobodies, in which at least one Nanobody is directed against a first antigen (i.e. against an APC target or T-cell target) and at least one Nanobody is directed against a second antigen (i.e. different from the APC target or T-cell target), will also be referred to as "multispecific" polypeptides of the invention, and the Nanobodies present in such polypeptides will also be referred to herein as being in a "multispecific format". Thus, for example, a "bispecific" polypeptide of the invention is a polypeptide that comprises at least one Nanobody directed against a first antigen (i.e. an APC target or T-cell target) and at least one further Nanobody directed against a second antigen (i.e. different from the APC target or T-cell target), whereas a "trispecific" polypeptide of the invention is a polypeptide that comprises at least one Nanobody directed against a first antigen (i.e. an APC target or T-cell target), at least one further Nanobody directed against a second antigen (i.e. different from the APC target or T-cell target) and at least one further Nanobody directed against a third antigen (i.e. different from both the APC target or T-cell target, and the second antigen); etc.

Accordingly, in its simplest form, a bispecific polypeptide of the invention is a bivalent polypeptide of the invention (as defined herein), comprising a first Nanobody directed against an APC target or T-cell target, and a second Nanobody directed against a second antigen, in which said first and second Nanobody may optionally be linked via a linker sequence (as defined herein); whereas a trispecific polypeptide of the invention in its simplest form is a trivalent polypeptide of the invention (as defined herein), comprising a first Nanobody directed against an APC target or T-cell target, a second Nanobody directed against a second antigen and a third Nanobody directed against a third antigen, in which said first, second and third Nanobody may optionally be linked via one or more, and in particular one and more, in particular two, linker sequences.

However, as will be clear from the description hereinabove, the invention is not limited thereto, in the sense that a multispecific polypeptide of the invention may comprise at least one Nanobody against an APC target or T-cell target, and any number of Nanobodies directed against one or more antigens different from the APC target or T-cell target.

Furthermore, although it is encompassed within the scope of the invention that the specific order or arrangement of the various Nanobodies in the polypeptides of the invention may have some influence on the properties of the final polypeptide of the invention (including but not limited to the affinity, specificity or avidity for the APC target or T-cell target, or against the one or more other antigens), said order or arrangement is usually not critical and may be suitably chosen by the skilled person, optionally after some limited routine experiments based on the disclosure herein. Thus, when reference is made to a specific multivalent or multispecific polypeptide of the invention, it should be noted that this encompasses any order or arrangements of the relevant Nanobodies, unless explicitly indicated otherwise.

Finally, it is also within the scope of the invention that the polypeptides of the invention contain two or more Nanobodies and one or more further amino acid sequences (as mentioned herein).

For multivalent and multispecific polypeptides containing one or more $V_{HH}$ domains and their preparation, reference is also made to Conrath et al., J. Biol. Chem., Vol. 276, 10. 7346-7350, 2001; Muyldermans, Reviews in Molecular Biotechnology 74 (2001), 277-302; as well as to for example WO 96/34103 and WO 99/23221. Some other examples of some specific multispecific and/or multivalent polypeptide of the invention can be found in the applications by Ablynx N.V. referred to herein.

One preferred, but non-limiting example of a multispecific polypeptide of the invention comprises at least one Nanobody of the invention and at least one Nanobody that provides for an increased half-life. Such Nanobodies may for example be Nanobodies that are directed against a serum protein, and in particular a human serum protein, such as human serum albumin, thyroxine-binding protein, (human) transferrin, fibrinogen, an immunoglobulin such as IgG, IgE or IgM, or against one of the serum proteins listed in WO 04/003019. Of these, Nanobodies that can bind to serum albumin (and in particular human serum albumin) or to IgG (and in particular human IgG, see for example Nanobody VH-1 described in the review by Muyldermans, supra) are particularly preferred (although for example, for experiments in mice or primates, Nanobodies against or cross-reactive with mouse serum albumin (MSA) or serum albumin from said primate, respectively, can be used. However, for pharmaceutical use, Nanobodies against human serum albumin or human IgG will usually be preferred). Nanobodies that provide for increased half-life and that can be used in the polypeptides of the invention include the Nanobodies directed against serum albumin that are described in WO 04/041865, in WO 06/122787 and in the further patent applications by Ablynx N.V., such as those mentioned above.

For example, the some preferred Nanobodies that provide for increased half-life for use in the present invention include Nanobodies that can bind to amino acid residues on (human) serum albumin that are not involved in binding of serum albumin to FcRn (see for example WO 06/0122787); Nanobodies that are capable of binding to amino acid residues on serum albumin that do not form part of domain III of serum albumin (see for example WO 06/0122787); Nanobodies that have or can provide an increased half-life (see for example the U.S. provisional application 60/843,349 by Ablynx N.V mentioned herein; see also PCT/EP2007/059475); Nanobodies against human serum albumin that are cross-reactive with serum albumin from at least one species of mammal, and in particular with at least one species of primate (such as, without limitation, monkeys from the genus *Macaca* (such as, and in particular, cynomologus monkeys (*Macaca fascicularis*) and/or rhesus monkeys (*Macaca mulatta*)) and baboon (*Papio ursinus*)) (see for example the U.S. provisional application 60/843,349 by Ablynx N.V; see also PCT/EP2007/059475); Nanobodies that can bind to serum albumin in a pH independent manner (see for example the U.S. provisional application 60/850,774 by Ablynx N.V. mentioned herein) and/or Nanobodies that are conditional binders (see for example the U.S. provisional application 60/850,775 by Ablynx N.V.; see also PCT/EP2007/060850).

Some particularly preferred Nanobodies that provide for increased half-life and that can be used in the polypeptides of the invention include the Nanobodies ALB-1 to ALB-10 disclosed in WO 06/122787 (see Tables II and III) of which ALB-8 (SEQ ID NO: 62 in WO 06/122787) is particularly preferred.

Some preferred, but non-limiting examples of polypeptides of the invention that comprise at least one Nanobody of the invention and at least one Nanobody that provides for increased half-life are given in SEQ ID NO's 286-305 and 1392-1395.

According to a specific, but non-limiting aspect of the invention, the polypeptides of the invention contain, besides the one or more Nanobodies of the invention, at least one Nanobody against human serum albumin.

Generally, any polypeptides of the invention with increased half-life that contain one or more Nanobodies of the invention, and any derivatives of Nanobodies of the invention or of such polypeptides that have an increased half-life, preferably have a half-life that is at least 1.5 times, preferably at least 2 times, such as at least 5 times, for example at least 10 times or more than 20 times, greater than the half-life of the corresponding Nanobody of the invention per se. For example, such a derivative or polypeptides with increased half-life may have a half-life that is increased with more than 1 hours, preferably more than 2 hours, more preferably more than 6 hours, such as more than 12 hours, or even more than 24, 48 or 72 hours, compared to the corresponding Nanobody of the invention per se.

In a preferred, but non-limiting aspect of the invention, such derivatives or polypeptides may exhibit a serum half-life in human of at least about 12 hours, preferably at least 24 hours, more preferably at least 48 hours, even more preferably at least 72 hours or more. For example, such derivatives or polypeptides may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

According to one aspect of the invention the polypeptides are capable of binding to one or more molecules which can increase the half-life of the polypeptide in vivo.

The polypeptides of the invention are stabilised in vivo and their half-life increased by binding to molecules which resist degradation and/or clearance or sequestration. Typically, such molecules are naturally occurring proteins which themselves have a long half-life in vivo.

Another preferred, but non-limiting example of a multispecific polypeptide of the invention comprises at least one Nanobody of the invention and at least one Nanobody that directs the polypeptide of the invention towards, and/or that allows the polypeptide of the invention to penetrate or to enter into specific organs, tissues, cells, or parts or compartments of cells, and/or that allows the Nanobody to penetrate or cross a biological barrier such as a cell membrane, a cell layer such as a layer of epithelial cells, a tumor including solid tumors, or the blood-brain-barrier. Examples of such Nanobodies include Nanobodies that are directed towards specific cell-surface proteins, markers or epitopes of the desired organ, tissue or cell (for example cell-surface markers associated with tumor cells), and the single-domain brain targeting antibody fragments described in WO 02/057445 and WO 06/040153, of which FC44 (SEQ ID NO: 189 of WO 06/040153) and FC5 (SEQ ID NO: 190 of WO 06/040154) are preferred examples.

In the polypeptides of the invention, the one or more Nanobodies and the one or more polypeptides may be directly linked to each other (as for example described in WO 99/23221) and/or may be linked to each other via one or more suitable spacers or linkers, or any combination thereof.

Suitable spacers or linkers for use in multivalent and multispecific polypeptides will be clear to the skilled person, and may generally be any linker or spacer used in the art to link amino acid sequences. Preferably, said linker or spacer is suitable for use in constructing proteins or polypeptides that are intended for pharmaceutical use.

Some particularly preferred spacers include the spacers and linkers that are used in the art to link antibody fragments or antibody domains. These include the linkers mentioned in the general background art cited above, as well as for example linkers that are used in the art to construct diabodies or ScFv fragments (in this respect, however, its should be noted that, whereas in diabodies and in ScFv fragments, the linker sequence used should have a length, a degree of flexibility and other properties that allow the pertinent $V_H$ and $V_L$ domains to come together to form the complete antigen-binding site, there is no particular limitation on the length or the flexibility of the linker used in the polypeptide of the invention, since each Nanobody by itself forms a complete antigen-binding site).

For example, a linker may be a suitable amino acid sequence, and in particular amino acid sequences of between 1 and 60, preferably between 1 and 50, more preferably between 1 and 30, such as between 1 and 10 amino acid residues. Some preferred examples of such amino acid sequences include gly-ser linkers, for example of the type $(gly_x ser_y)_2$, such as (for example $(gly_4 ser)_3$ or $(gly_3 ser_2)_3$, as described in WO 99/42077 and the GS30, GS15, GS9 and GS7 linkers described in the applications by Ablynx mentioned herein (see for example WO 06/040153 and WO 06/122825), as well as hinge-like regions, such as the hinge regions of naturally occurring heavy chain antibodies or similar sequences (such as described in WO 94/04678).

Some other particularly preferred linkers are poly-alanine (such as AAA), as well as the linkers GS40, GS35, GS30 (SEQ ID NO: 85 in WO 06/122825) and GS9 (SEQ ID NO: 84 in WO 06/122825).

In a specific embodiment, when the multivalent (such as e.g. bivalent) polypeptide of the invention binds identical (or different) binding sites on different subunits of a mutimer (such as e.g. a dimer; such as e.g. CTLA4), the linker used in the polypeptide of the invention may be an amino acid sequence wherein the number of amino acid residues is more than 30, preferably more than 35, more preferably more than 40, such as between 30 and 60, between 35 and 60 or between 40 and 60.

Other suitable linkers generally comprise organic compounds or polymers, in particular those suitable for use in proteins for pharmaceutical use. For instance, poly(ethyleneglycol) moieties have been used to link antibody domains, see for example WO 04/081026.

It is encompassed within the scope of the invention that the length, the degree of flexibility and/or other properties of the linker(s) used (although not critical, as it usually is for linkers used in ScFv fragments) may have some influence on the properties of the final polypeptide of the invention, including but not limited to the affinity, specificity or avidity for the APC target or T-cell target, or for one or more of the other antigens. Based on the disclosure herein, the skilled person will be able to determine the optimal linker(s) for use in a specific polypeptide of the invention, optionally after some limited routine experiments.

For example, in multivalent polypeptides of the invention that comprise Nanobodies directed against a multimeric antigen (such as a multimeric receptor or other protein), the length and flexibility of the linker are preferably such that it allows each Nanobody of the invention present in the polypeptide to bind to the antigenic determinant on each of the subunits of the multimer. Similarly, in a multispecific polypeptide of the invention that comprises Nanobodies directed against two or more different antigenic determinants on the same antigen (for example against different epitopes of an antigen and/or against different subunits of a multimeric receptor, channel or protein), the length and flexibility of the linker are preferably such that it allows each Nanobody to bind to its intended antigenic determinant. Again, based on the disclosure herein, the skilled person will be able to determine the optimal linker(s) for use in a specific polypeptide of the invention, optionally after some limited routine experiments.

It is also within the scope of the invention that the linker(s) used confer one or more other favourable properties or functionality to the polypeptides of the invention, and/or provide one or more sites for the formation of derivatives and/or for the attachment of functional groups (e.g. as described herein for the derivatives of the Nanobodies of the invention). For example, linkers containing one or more charged amino acid residues (see Table A-2 above) can provide improved hydrophilic properties, whereas linkers that form or contain small epitopes or tags can be used for the purposes of detection, identification and/or purification. Again, based on the disclosure herein, the skilled person will be able to determine the optimal linkers for use in a specific polypeptide of the invention, optionally after some limited routine experiments.

Finally, when two or more linkers are used in the polypeptides of the invention, these linkers may be the same or different. Again, based on the disclosure herein, the skilled person will be able to determine the optimal linkers for use in a specific polypeptide of the invention, optionally after some limited routine experiments.

Usually, for easy of expression and production, a polypeptide of the invention will be a linear polypeptide. However, the invention in its broadest sense is not limited thererto. For example, when a polypeptide of the invention comprises three of more Nanobodies, it is possible to link them by use of a linker with three or more "arms", which each "arm" being linked to a Nanobody, so as to provide a "star-shaped" construct. It is also possible, although usually less preferred, to use circular constructs.

The invention also comprises derivatives of the polypeptides of the invention, which may be essentially analogous to the derivatives of the Nanobodies of the invention, i.e. as described herein.

The invention also comprises proteins or polypeptides that "essentially consist" of a polypeptide of the invention (in which the wording "essentially consist of" has essentially the same meaning as indicated hereinabove).

According to one aspect of the invention, the polypeptide of the invention is in essentially isolated from, as defined herein.

The amino acid sequences, Nanobodies, polypeptides and nucleic acids of the invention can be prepared in a manner known per se, as will be clear to the skilled person from the further description herein. For example, the Nanobodies and polypeptides of the invention can be prepared in any manner known per se for the preparation of antibodies and in particular for the preparation of antibody fragments (including but not limited to (single) domain antibodies and ScFv fragments). Some preferred, but non-limiting methods for preparing the amino acid sequences, Nanobodies, polypeptides and nucleic acids include the methods and techniques described herein.

As will be clear to the skilled person, one particularly useful method for preparing an amino acid sequence, Nanobody and/or a polypeptide of the invention generally comprises the steps of:
i) the expression, in a suitable host cell or host organism (also referred to herein as a "host of the invention") or in another suitable expression system of a nucleic acid that encodes said amino acid sequence, Nanobody or polypeptide of the invention (also referred to herein as a "nucleic acid of the invention"), optionally followed by:
ii) isolating and/or purifying the amino acid sequence, Nanobody or polypeptide of the invention thus obtained.

In particular, such a method may comprise the steps of:
i) cultivating and/or maintaining a host of the invention under conditions that are such that said host of the invention expresses and/or produces at least one amino acid sequence, Nanobody and/or polypeptide of the invention; optionally followed by:
ii) isolating and/or purifying the amino acid sequence, Nanobody or polypeptide of the invention thus obtained.

A nucleic acid of the invention can be in the form of single or double stranded DNA or RNA, and is preferably in the form of double stranded DNA. For example, the nucleotide sequences of the invention may be genomic DNA, cDNA or synthetic DNA (such as DNA with a codon usage that has been specifically adapted for expression in the intended host cell or host organism).

According to one aspect of the invention, the nucleic acid of the invention is in essentially isolated from, as defined herein.

The nucleic acid of the invention may also be in the form of, be present in and/or be part of a vector, such as for example a plasmid, cosmid or YAC, which again may be in essentially isolated form.

The nucleic acids of the invention can be prepared or obtained in a manner known per se, based on the information on the amino acid sequences for the polypeptides of the invention given herein, and/or can be isolated from a suitable natural source. To provide analogs, nucleotide sequences encoding naturally occurring $V_{HH}$ domains can for example be subjected to site-directed mutagenesis, so at to provide a nucleic acid of the invention encoding said analog. Also, as will be clear to the skilled person, to prepare a nucleic acid of the invention, also several nucleotide sequences, such as at least one nucleotide sequence encoding a Nanobody and for example nucleic acids encoding one or more linkers can be linked together in a suitable manner.

Techniques for generating the nucleic acids of the invention will be clear to the skilled person and may for instance include, but are not limited to, automated DNA synthesis; site-directed mutagenesis; combining two or more naturally occurring and/or synthetic sequences (or two or more parts thereof), introduction of mutations that lead to the expression of a truncated expression product; introduction of one or more restriction sites (e.g. to create cassettes and/or regions that may easily be digested and/or ligated using suitable restriction enzymes), and/or the introduction of mutations by means of a PCR reaction using one or more "mismatched" primers, using for example a sequence of a naturally occurring form of the amino acid sequence as a template. These and other techniques will be clear to the skilled person, and reference is again made to the standard handbooks, such as Sambrook et al. and Ausubel et al., mentioned above, as well as the Examples below.

The nucleic acid of the invention may also be in the form of, be present in and/or be part of a genetic construct, as will be clear to the person skilled in the art. Such genetic constructs generally comprise at least one nucleic acid of the invention that is optionally linked to one or more elements of genetic constructs known per se, such as for example one or more suitable regulatory elements (such as a suitable promoter(s), enhancer(s), terminator(s), etc.) and the further elements of genetic constructs referred to herein. Such genetic constructs comprising at least one nucleic acid of the invention will also be referred to herein as "genetic constructs of the invention".

The genetic constructs of the invention may be DNA or RNA, and are preferably double-stranded DNA. The genetic constructs of the invention may also be in a form suitable for transformation of the intended host cell or host organism, in a form suitable for integration into the genomic DNA of the intended host cell or in a form suitable for independent replication, maintenance and/or inheritance in the intended host organism. For instance, the genetic constructs of the invention may be in the form of a vector, such as for example a plasmid, cosmid, YAC, a viral vector or transposon. In particular, the vector may be an expression vector, i.e. a vector that can provide for expression in vitro and/or in vivo (e.g. in a suitable host cell, host organism and/or expression system).

In a preferred but non-limiting aspect, a genetic construct of the invention comprises
i) at least one nucleic acid of the invention; operably connected to
ii) one or more regulatory elements, such as a promoter and optionally a suitable terminator;
and optionally also
iii) one or more further elements of genetic constructs known per se;
in which the terms "regulatory element", "promoter", "terminator" and "operably connected" have their usual meaning in the art (as further described herein); and in which said "further elements" present in the genetic constructs may for example be 3'- or 5'-UTR sequences, leader sequences, selection markers, expression markers/reporter genes, and/or elements that may facilitate or increase (the efficiency of) transformation or integration. These and other suitable elements for such genetic constructs will be clear to the skilled person, and may for instance depend upon the type of construct used, the intended host cell or host organism; the manner in which the nucleotide sequences of the invention of interest are to be expressed (e.g. via constitutive, transient or inducible expression); and/or the transformation technique to be used. For example, regulatory requences, promoters and terminators known per se for the expression and production of antibodies and antibody fragments (including but not limited to (single) domain antibodies and ScFv fragments) may be used in an essentially analogous manner.

Preferably, in the genetic constructs of the invention, said at least one nucleic acid of the invention and said regulatory elements, and optionally said one or more further elements, are "operably linked" to each other, by which is generally meant that they are in a functional relationship with each other. For instance, a promoter is considered "operably linked" to a coding sequence if said promoter is able to initiate or otherwise control/regulate the transcription and/or the expression of a coding sequence (in which said coding sequence should be understood as being "under the control of" said promoter). Generally, when two nucleotide sequences are operably linked, they will be in the same orientation and usually also in the same reading frame. They will usually also be essentially contiguous, although this may also not be required.

Preferably, the regulatory and further elements of the genetic constructs of the invention are such that they are capable of providing their intended biological function in the intended host cell or host organism.

For instance, a promoter, enhancer or terminator should be "operable" in the intended host cell or host organism, by which is meant that (for example) said promoter should be capable of initiating or otherwise controlling/regulating the transcription and/or the expression of a nucleotide sequence—e.g. a coding sequence—to which it is operably linked (as defined herein).

Some particularly preferred promoters include, but are not limited to, promoters known per se for the expression in the host cells mentioned herein; and in particular promoters for the expression in the bacterial cells, such as those mentioned herein and/or those used in the Examples.

A selection marker should be such that it allows—i.e. under appropriate selection conditions—host cells and/or host organisms that have been (successfully) transformed with the nucleotide sequence of the invention to be distinguished from host cells/organisms that have not been (successfully) transformed. Some preferred, but non-limiting examples of such markers are genes that provide resistance against antibiotics (such as kanamycin or ampicillin), genes that provide for temperature resistance, or genes that allow the host cell or host organism to be maintained in the absence of certain factors, compounds and/or (food) components in the medium that are essential for survival of the non-transformed cells or organisms.

A leader sequence should be such that—in the intended host cell or host organism—it allows for the desired post-translational modifications and/or such that it directs the transcribed mRNA to a desired part or organelle of a cell. A leader sequence may also allow for secretion of the expression product from said cell. As such, the leader sequence may be any pro-, pre-, or prepro-sequence operable in the host cell or host organism. Leader sequences may not be required for expression in a bacterial cell. For example, leader sequences known per se for the expression and production of antibodies and antibody fragments (including but not limited to single domain antibodies and ScFv fragments) may be used in an essentially analogous manner.

An expression marker or reporter gene should be such that—in the host cell or host organism—it allows for detection of the expression of (a gene or nucleotide sequence present on) the genetic construct. An expression marker may optionally also allow for the localisation of the expressed product, e.g. in a specific part or organelle of a cell and/or in (a) specific cell(s), tissue(s), organ(s) or part(s) of a multicellular organism. Such reporter genes may also be expressed as a protein fusion with the amino acid sequence of the invention. Some preferred, but non-limiting examples include fluorescent proteins such as GFP.

Some preferred, but non-limiting examples of suitable promoters, terminator and further elements include those that can be used for the expression in the host cells mentioned herein; and in particular those that are suitable for expression in bacterial cells, such as those mentioned herein and/or those used in the Examples below. For some (further) non-limiting examples of the promoters, selection markers, leader sequences, expression markers and further elements that may be present/used in the genetic constructs of the invention—such as terminators, transcriptional and/or translational enhancers and/or integration factors—reference is made to the general handbooks such as Sambrook et al. and Ausubel et al. mentioned above, as well as to the examples that are given in WO 95/07463, WO 96/23810, WO 95/07463, WO 95/21191, WO 97/11094, WO 97/42320, WO 98/06737, WO 98/21355, U.S. Pat. No. 7,207,410, U.S. Pat. No. 5,693,492 and EP 1 085 089. Other examples will be clear to the skilled person. Reference is also made to the general background art cited above and the further references cited herein.

The genetic constructs of the invention may generally be provided by suitably linking the nucleotide sequence(s) of the invention to the one or more further elements described above, for example using the techniques described in the general handbooks such as Sambrook et al. and Ausubel et al., mentioned above.

Often, the genetic constructs of the invention will be obtained by inserting a nucleotide sequence of the invention in a suitable (expression) vector known per se. Some preferred, but non-limiting examples of suitable expression vectors are those used in the Examples below, as well as those mentioned herein.

The nucleic acids of the invention and/or the genetic constructs of the invention may be used to transform a host cell or host organism, i.e. for expression and/or production of the amino acid sequence, Nanobody or polypeptide of the invention. Suitable hosts or host cells will be clear to the skilled person, and may for example be any suitable fungal, prokaryotic or eukaryotic cell or cell line or any suitable fungal, prokaryotic or eukaryotic organism, for example:

- a bacterial strain, including but not limited to gram-negative strains such as strains of *Escherichia coli*; of *Proteus*, for example of *Proteus mirabilis*; of *Pseudomonas*, for example of *Pseudomonas fluorescens*; and gram-positive strains such as strains of *Bacillus*, for example of *Bacillus subtilis* or of *Bacillus brevis*; of *Streptomyces*, for example of *Streptomyces lividans*; of *Staphylococcus*, for example of *Staphylococcus carnosus*; and of *Lactococcus*, for example of *Lactococcus lactis*;
- a fungal cell, including but not limited to cells from species of *Trichoderma*, for example from *Trichoderma reesei*; of *Neurospora*, for example from *Neurospora crassa*; of *Sordaria*, for example from *Sordaria macrospora*; of *Aspergillus*, for example from *Aspergillus niger* or from *Aspergillus sojae*; or from other filamentous fungi;
- a yeast cell, including but not limited to cells from species of *Saccharomyces*, for example of *Saccharomyces cerevisiae*; of *Schizosaccharomyces*, for example of *Schizosaccharomyces pombe*; of *Pichia*, for example of *Pichia pastoris* or of *Pichia methanolica*; of *Hansenula*, for example of *Hansenula polymorpha*; of *Kluyveromyces*, for example of *Kluyveromyces lactis*; of *Arxula*, for example of *Arxula adeninivorans*; of *Yarrowia*, for example of *Yarrowia lipolytica*;
- an amphibian cell or cell line, such as *Xenopus* oocytes;
- an insect-derived cell or cell line, such as cells/cell lines derived from *lepidoptera*, including but not limited to *Spodoptera* SF9 and Sf21 cells or cells/cell lines derived from *Drosophila*, such as Schneider and Kc cells;
- a plant or plant cell, for example in tobacco plants; and/or
- a mammalian cell or cell line, for example a cell or cell line derived from a human, a cell or a cell line from mammals including but not limited to CHO-cells, BHK-cells (for example BHK-21 cells) and human cells or cell lines such as HeLa, COS (for example COS-7) and PER.C6 cells;

as well as all other hosts or host cells known per se for the expression and production of antibodies and antibody fragments (including but not limited to (single) domain antibodies and ScFv fragments), which will be clear to the skilled person. Reference is also made to the general background art cited hereinabove, as well as to for example WO 94/29457; WO 96/34103; WO 99/42077; Frenken et al., (1998), supra; Riechmann and Muyldermans, (1999), supra; van der Linden, (2000), supra; Thomassen et al., (2002), supra; Joosten et al., (2003), supra; Joosten et al., (2005), supra; and the further references cited herein.

The amino acid sequences, Nanobodies and polypeptides of the invention can also be introduced and expressed in one or more cells, tissues or organs of a multicellular organism, for example for prophylactic and/or therapeutic purposes (e.g. as a gene therapy). For this purpose, the nucleotide sequences of the invention may be introduced into the cells or tissues in any suitable way, for example as such (e.g. using liposomes) or after they have been inserted into a suitable gene therapy vector (for example derived from retroviruses such as adenovirus, or parvoviruses such as adeno-associated virus). As will also be clear to the skilled person, such gene therapy may be performed in vivo and/or in situ in the body of a patient by administering a nucleic acid of the invention or a suitable gene therapy vector encoding the same to the patient or to specific cells or a specific tissue or organ of the patient; or suitable cells (often taken from the body of the patient to be treated, such as explanted lymphocytes, bone marrow aspirates or tissue biopsies) may be treated in vitro with a nucleotide sequence of the invention and then be suitably (re-) introduced into the body of the patient. All this can be performed using gene therapy vectors, techniques and delivery systems which are well known to the skilled person, and for example described in Culver, K. W., "Gene Therapy", 1994, p. xii, Mary Ann Liebert, Inc., Publishers, New York, N.Y.); Giordano, Nature F Medicine 2 (1996), 534-539; Schaper, Circ. Res. 79 (1996), 911-919; Anderson, Science 256 (1992), 808-813; Verma, Nature 389 (1994), 239; Isner, Lancet 348 (1996), 370-374; Muhlhauser, Circ. Res. 77 (1995), 1077-1086; Onodera, Blood 91; (1998), 30-36; Verma, Gene Ther. 5 (1998), 692-699; Nabel, Ann. N.Y. Acad. Sci.: 811 (1997), 289-292; Verzeletti, Hum. Gene Ther. 9 (1998), 2243-51; Wang, Nature Medicine 2 (1996), 714-716; WO 94/29469; WO 97/00957, U.S. Pat. No. 5,580,859; U.S. Pat. No. 5,589,5466; or Schaper, Current Opinion in Biotechnology 7 (1996), 635-640. For example, in situ expression of ScFv fragments (Afanasieva et al., Gene Ther., 10, 1850-1859 (2003)) and of diabodies (Blanco et al., J. Immunol, 171, 1070-1077 (2003)) has been described in the art.

For expression of the Nanobodies in a cell, they may also be expressed as so-called "intrabodies", as for example described in WO 94/02610, WO 95/22618 and U.S. Pat. No. 7,004,940; WO 03/014960; in Cattaneo, A. & Biocca, S. (1997) Intracellular Antibodies: Development and Applications. Landes and Springer-Verlag; and in Kontermann, Methods 34, (2004), 163-170.

The amino acid sequences, Nanobodies and polypeptides of the invention can for example also be produced in the milk of transgenic mammals, for example in the milk of rabbits, cows, goats or sheep (see for example U.S. Pat. No. 6,741, 957, U.S. Pat. No. 6,304,489 and U.S. Pat. No. 6,849,992 for general techniques for introducing transgenes into mammals), in plants or parts of plants including but not limited to their leaves, flowers, fruits, seed, roots or turbers (for example in tobacco, maize, soybean or alfalfa) or in for example pupae of the silkworm *Bombix mori*.

Furthermore, the amino acid sequences, Nanobodies and polypeptides of the invention can also be expressed and/or produced in cell-free expression systems, and suitable examples of such systems will be clear to the skilled person. Some preferred, but non-limiting examples include expression in the wheat germ system; in rabbit reticulocyte lysates; or in the *E. coli* Zubay system.

As mentioned above, one of the advantages of the use of Nanobodies is that the polypeptides based thereon can be prepared through expression in a suitable bacterial system, and suitable bacterial expression systems, vectors, host cells, regulatory elements, etc., will be clear to the skilled person, for example from the references cited above. It should however be noted that the invention in its broadest sense is not limited to expression in bacterial systems.

Preferably, in the invention, an (in vivo or in vitro) expression system, such as a bacterial expression system, is used that provides the polypeptides of the invention in a form that is suitable for pharmaceutical use, and such expression systems will again be clear to the skilled person. As also will be clear to the skilled person, polypeptides of the invention suitable for pharmaceutical use can be prepared using techniques for peptide synthesis.

For production on industrial scale, preferred heterologous hosts for the (industrial) production of Nanobodies or Nanobody-containing protein therapeutics include strains of *E. coli, Pichia pastoris, S. cerevisiae* that are suitable for large scale expression/production/fermentation, and in particular for large scale pharmaceutical (i.e. GMP grade) expression/production/fermentation. Suitable examples of such strains will be clear to the skilled person. Such strains and production/expression systems are also made available by companies such as Biovitrum (Uppsala, Sweden).

Alternatively, mammalian cell lines, in particular Chinese hamster ovary (CHO) cells, can be used for large scale expression/production/fermentation, and in particular for large scale pharmaceutical expression/production/fermentation. Again, such expression/production systems are also made available by some of the companies mentioned above.

The choice of the specific expression system would depend in part on the requirement for certain post-translational modifications, more specifically glycosylation. The production of a Nanobody-containing recombinant protein for which glycosylation is desired or required would necessitate the use of mammalian expression hosts that have the ability to glycosylate the expressed protein. In this respect, it will be clear to the skilled person that the glycosylation pattern obtained (i.e. the kind, number and position of residues attached) will depend on the cell or cell line that is used for the expression. Preferably, either a human cell or cell line is used (i.e. leading to a protein that essentially has a human glycosylation pattern) or another mammalian cell line is used that can provide a glycosylation pattern that is essentially and/or functionally the same as human glycosylation or at least mimics human glycosylation. Generally, prokaryotic hosts such as *E. coli* do not have the ability to glycosylate proteins, and the use of lower eukaryotes such as yeast usually leads to a glycosylation pattern that differs from human glycosylation. Nevertheless, it should be understood that all the foregoing host cells and expression systems can be used in the invention, depending on the desired amino acid sequence, Nanobody or polypeptide to be obtained.

Thus, according to one non-limiting aspect of the invention, the amino acid sequence, Nanobody or polypeptide of the invention is glycosylated. According to another non-limiting aspect of the invention, the amino acid sequence, Nanobody or polypeptide of the invention is non-glycosylated.

According to one preferred, but non-limiting aspect of the invention, the amino acid sequence, Nanobody or polypeptide of the invention is produced in a bacterial cell, in particular a bacterial cell suitable for large scale pharmaceutical production, such as cells of the strains mentioned above.

According to another preferred, but non-limiting aspect of the invention, the amino acid sequence, Nanobody or polypeptide of the invention is produced in a yeast cell, in particular a yeast cell suitable for large scale pharmaceutical production, such as cells of the species mentioned above.

According to yet another preferred, but non-limiting aspect of the invention, the amino acid sequence, Nanobody or polypeptide of the invention is produced in a mammalian cell, in particular in a human cell or in a cell of a human cell line, and more in particular in a human cell or in a cell of a human cell line that is suitable for large scale pharmaceutical production, such as the cell lines mentioned hereinabove.

When expression in a host cell is used to produce the amino acid sequences, Nanobodies and the polypeptides of the invention, the amino acid sequences, Nanobodies and polypeptides of the invention can be produced either intracellularly (e.g. in the cytosol, in the periplasma or in inclusion bodies) and then isolated from the host cells and optionally further purified; or can be produced extracellularly (e.g. in the medium in which the host cells are cultured) and then isolated from the culture medium and optionally further purified. When eukaryotic host cells are used, extracellular production is usually preferred since this considerably facilitates the further isolation and downstream processing of the Nanobodies and proteins obtained. Bacterial cells such as the strains of *E. coli* mentioned above normally do not secrete proteins extracellularly, except for a few classes of proteins such as toxins and hemolysin, and secretory production in *E. coli* refers to the translocation of proteins across the inner membrane to the periplasmic space. Periplasmic production provides several advantages over cytosolic production. For example, the N-terminal amino acid sequence of the secreted product can be identical to the natural gene product after cleavage of the secretion signal sequence by a specific signal peptidase. Also, there appears to be much less protease activity in the periplasm than in the cytoplasm. In addition, protein purification is simpler due to fewer contaminating proteins in the periplasm. Another advantage is that correct disulfide bonds may form because the periplasm provides a more oxidative environment than the cytoplasm. Proteins overexpressed in *E. coli* are often found in insoluble aggregates, so-called inclusion bodies. These inclusion bodies may be located in the cytosol or in the periplasm; the recovery of biologically active proteins from these inclusion bodies requires a denaturation/refolding process. Many recombinant proteins, including therapeutic proteins, are recovered from inclusion bodies. Alternatively, as will be clear to the skilled person, recombinant strains of bacteria that have been genetically modified so as to secrete a desired protein, and in particular an amino acid sequence, Nanobody or a polypeptide of the invention, can be used.

Thus, according to one non-limiting aspect of the invention, the amino acid sequence, Nanobody or polypeptide of the invention is an amino acid sequence, Nanobody or polypeptide that has been produced intracellularly and that has been isolated from the host cell, and in particular from a bacterial cell or from an inclusion body in a bacterial cell. According to another non-limiting aspect of the invention, the amino acid sequence, Nanobody or polypeptide of the invention is an amino acid sequence, Nanobody or polypeptide that has been produced extracellularly, and that has been isolated from the medium in which the host cell is cultivated.

Some preferred, but non-limiting promoters for use with these host cells include,
- for expression in *E. coli*: lac promoter (and derivatives thereof such as the lacUV5 promoter); arabinose promoter; left- (PL) and rightward (PR) promoter of phage lambda; promoter of the trp operon; hybrid lac/trp promoters (tac and trc); T7-promoter (more specifically that of T7-phage gene 10) and other T-phage promoters; promoter of the Tn10 tetracycline resistance gene; engineered variants of the above promoters that include one or more copies of an extraneous regulatory operator sequence;
- for expression in *S. cerevisiae*: constitutive: ADH1 (alcohol dehydrogenase 1), ENO (enolase), CYC1 (cytochrome c iso-1), GAPDH (glyceraldehydes-3-phosphate dehydrogenase), PGK1 (phosphoglycerate kinase), PYK1 (pyruvate kinase); regulated: GAL1, 10, 7 (galactose metabolic enzymes), ADH2 (alcohol dehydrogenase 2), PHO5 (acid phosphatase), CUP1 (copper metallothionein); heterologous: CaMV (cauliflower mosaic virus 35S promoter);
- for expression in *Pichia pastoris*: the AOX1 promoter (alcohol oxidase I);
- for expression in mammalian cells: human cytomegalovirus (HCMV) immediate early enhancer/promoter; human cytomegalovirus (hCMV) immediate early promoter variant that contains two tetracycline operator sequences such that the promoter can be regulated by the Tet repressor; Herpes Simplex Virus thymidine kinase (TK) promoter; Rous Sarcoma Virus long terminal repeat (RSV LTR) enhancer/promoter; elongation factor 1α (hEF-1α) promoter from human, chimpanzee, mouse or rat; the SV40 early promoter; HIV-1 long terminal repeat promoter; β-actin promoter;

Some preferred, but non-limiting vectors for use with these host cells include:
- vectors for expression in mammalian cells: pMAMneo (Clontech), pcDNA3 (Invitrogen), pMC1neo (Stratagene), pSG5 (Stratagene), EBO-pSV2-neo (ATCC 37593), pBPV-1 (8-2) (ATCC 37110), pdBPV-MMTneo (342-12) (ATCC 37224), pRSVgpt (ATCC37199), pRSVneo (ATCC37198), pSV2-dhfr (ATCC 37146), pUC-Tag (ATCC 37460) and IZD35 (ATCC 37565), as well as viral-based expression systems, such as those based on adenovirus;
- vectors for expression in bacterial cells: pET vectors (Novagen) and pQE vectors (Qiagen);
- vectors for expression in yeast or other fungal cells: pYES2 (Invitrogen) and *Pichia* expression vectors (Invitrogen);
- vectors for expression in insect cells: pBlueBacII (Invitrogen) and other baculovirus vectors
- vectors for expression in plants or plant cells: for example vectors based on cauliflower mosaic virus or tobacco mosaic virus, suitable strains of *Agrobacterium*, or Ti-plasmid based vectors.

Some preferred, but non-limiting secretory sequences for use with these host cells include:
- for use in bacterial cells such as *E. coli*: PelB, Bla, OmpA, OmpC, OmpF, OmpT, StII, PhoA, PhoE, MalE, Lpp, LamB, and the like; TAT signal peptide, hemolysin C-terminal secretion signal;
- for use in yeast: α-mating factor prepro-sequence, phosphatase (pho1), invertase (Suc), etc.;

for use in mammalian cells: indigenous signal in case the target protein is of eukaryotic origin; murine Ig κ-chain V-J2-C signal peptide; etc.

Suitable techniques for transforming a host or host cell of the invention will be clear to the skilled person and may depend on the intended host cell/host organism and the genetic construct to be used. Reference is again made to the handbooks and patent applications mentioned above.

After transformation, a step for detecting and selecting those host cells or host organisms that have been successfully transformed with the nucleotide sequence/genetic construct of the invention may be performed. This may for instance be a selection step based on a selectable marker present in the genetic construct of the invention or a step involving the detection of the amino acid sequence of the invention, e.g. using specific antibodies.

The transformed host cell (which may be in the form or a stable cell line) or host organisms (which may be in the form of a stable mutant line or strain) form further aspects of the present invention.

Preferably, these host cells or host organisms are such that they express, or are (at least) capable of expressing (e.g. under suitable conditions), an amino acid sequence, Nanobody or polypeptide of the invention (and in case of a host organism: in at least one cell, part, tissue or organ thereof). The invention also includes further generations, progeny and/or offspring of the host cell or host organism of the invention, that may for instance be obtained by cell division or by sexual or asexual reproduction.

To produce/obtain expression of the amino acid sequences of the invention, the transformed host cell or transformed host organism may generally be kept, maintained and/or cultured under conditions such that the (desired) amino acid sequence, Nanobody or polypeptide of the invention is expressed/produced. Suitable conditions will be clear to the skilled person and will usually depend upon the host cell/host organism used, as well as on the regulatory elements that control the expression of the (relevant) nucleotide sequence of the invention. Again, reference is made to the handbooks and patent applications mentioned above in the paragraphs on the genetic constructs of the invention.

Generally, suitable conditions may include the use of a suitable medium, the presence of a suitable source of food and/or suitable nutrients, the use of a suitable temperature, and optionally the presence of a suitable inducing factor or compound (e.g. when the nucleotide sequences of the invention are under the control of an inducible promoter); all of which may be selected by the skilled person. Again, under such conditions, the amino acid sequences of the invention may be expressed in a constitutive manner, in a transient manner, or only when suitably induced.

It will also be clear to the skilled person that the amino acid sequence, Nanobody or polypeptide of the invention may (first) be generated in an immature form (as mentioned above), which may then be subjected to post-translational modification, depending on the host cell/host organism used. Also, the amino acid sequence, Nanobody or polypeptide of the invention may be glycosylated, again depending on the host cell/host organism used.

The amino acid sequence, Nanobody or polypeptide of the invention may then be isolated from the host cell/host organism and/or from the medium in which said host cell or host organism was cultivated, using protein isolation and/or purification techniques known per se, such as (preparative) chromatography and/or electrophoresis techniques, differential precipitation techniques, affinity techniques (e.g. using a specific, cleavable amino acid sequence fused with the amino acid sequence, Nanobody or polypeptide of the invention) and/or preparative immunological techniques (i.e. using antibodies against the amino acid sequence to be isolated).

Generally, for pharmaceutical use, the polypeptides of the invention may be formulated as a pharmaceutical preparation or compositions comprising at least one polypeptide of the invention and at least one pharmaceutically acceptable carrier, diluent or excipient and/or adjuvant, and optionally one or more further pharmaceutically active polypeptides and/or compounds. By means of non-limiting examples, such a formulation may be in a form suitable for oral administration, for parenteral administration (such as by intravenous, intramuscular or subcutaneous injection or intravenous infusion), for topical administration, for administration by inhalation, by a skin patch, by an implant, by a suppository, etc. Such suitable administration forms—which may be solid, semi-solid or liquid, depending on the manner of administration—as well as methods and carriers for use in the preparation thereof, will be clear to the skilled person, and are further described herein.

Thus, in a further aspect, the invention relates to a pharmaceutical composition that contains at least one amino acid of the invention, at least one Nanobody of the invention or at least one polypeptide of the invention and at least one suitable carrier, diluent or excipient (i.e. suitable for pharmaceutical use), and optionally one or more further active substances.

Generally, the amino acid sequences, Nanobodies and polypeptides of the invention can be formulated and administered in any suitable manner known per se, for which reference is for example made to the general background art cited above (and in particular to WO 04/041862, WO 04/041863, WO 04/041865 and WO 04/041867) as well as to the standard handbooks, such as Remington's Pharmaceutical Sciences, 18$^{th}$ Ed., Mack Publishing Company, USA (1990) or Remington, the Science and Practice of Pharmacy, 21th Edition, Lippincott Williams and Wilkins (2005).

For example, the amino acid sequences, Nanobodies and polypeptides of the invention may be formulated and administered in any manner known per se for conventional antibodies and antibody fragments (including ScFv's and diabodies) and other pharmaceutically active proteins. Such formulations and methods for preparing the same will be clear to the skilled person, and for example include preparations suitable for parenteral administration (for example intravenous, intraperitoneal, subcutaneous, intramuscular, intraluminal, intraarterial or intrathecal administration) or for topical (i.e. transdermal or intradermal) administration.

Preparations for parenteral administration may for example be sterile solutions, suspensions, dispersions or emulsions that are suitable for infusion or injection. Suitable carriers or diluents for such preparations for example include, without limitation, sterile water and aqueous buffers and solutions such as physiological phosphate-buffered saline, Ringer's solutions, dextrose solution, and Hank's solution; water oils; glycerol; ethanol; glycols such as propylene glycol or as well as mineral oils, animal oils and vegetable oils, for example peanut oil, soybean oil, as well as suitable mixtures thereof. Usually, aqueous solutions or suspensions will be preferred.

The amino acid sequences, Nanobodies and polypeptides of the invention can also be administered using gene therapy methods of delivery. See, e.g., U.S. Pat. No. 5,399,346, which is incorporated by reference in its entirety. Using a gene therapy method of delivery, primary cells transfected with the gene encoding an amino acid sequence, Nanobody or polypeptide of the invention can additionally be transfected with tissue specific promoters to target specific organs, tissue, grafts, tumors, or cells and can additionally be transfected with signal and stabilization sequences for subcellularly localized expression.

Thus, the amino acid sequences, Nanobodies and polypeptides of the invention may be systemically administered, e.g., orally, in combination with a pharmaceutically acceptable vehicle such as an inert diluent or an assimilable edible carrier. They may be enclosed in hard or soft shell gelatin capsules, may be compressed into tablets, or may be incorporated directly with the food of the patient's diet. For oral therapeutic administration, the amino acid sequences, Nanobodies and polypeptides of the invention may be combined with one or more excipients and used in the form of ingestible tablets, buccal tablets, troches, capsules, elixirs, suspensions, syrups, wafers, and the like. Such compositions and preparations should contain at least 0.1% of the amino acid sequence, Nanobody or polypeptide of the invention. Their percentage in the compositions and preparations may, of course, be varied and may conveniently be between about 2 to about 60% of the weight of a given unit dosage form. The amount of the amino acid sequence, Nanobody or polypeptide of the invention in such therapeutically useful compositions is such that an effective dosage level will be obtained.

The tablets, troches, pills, capsules, and the like may also contain the following: binders such as gum tragacanth, acacia, corn starch or gelatin; excipients such as dicalcium phosphate; a disintegrating agent such as corn starch, potato starch, alginic acid and the like; a lubricant such as magnesium stearate; and a sweetening agent such as sucrose, fructose, lactose or aspartame or a flavoring agent such as peppermint, oil of wintergreen, or cherry flavoring may be added. When the unit dosage form is a capsule, it may contain, in addition to materials of the above type, a liquid carrier, such as a vegetable oil or a polyethylene glycol. Various other materials may be present as coatings or to otherwise modify the physical form of the solid unit dosage form. For instance, tablets, pills, or capsules may be coated with gelatin, wax, shellac or sugar and the like. A syrup or elixir may contain the amino acid sequences, Nanobodies and polypeptides of the invention, sucrose or fructose as a sweetening agent, methyl and propylparabens as preservatives, a dye and flavoring such as cherry or orange flavor. Of course, any material used in preparing any unit dosage form should be pharmaceutically acceptable and substantially non-toxic in the amounts employed. In addition, the amino acid sequences, Nanobodies and polypeptides of the invention may be incorporated into sustained-release preparations and devices.

Preparations and formulations for oral administration may also be provided with an enteric coating that will allow the constructs of the invention to resist the gastric environment and pass into the intestines. More generally, preparations and formulations for oral administration may be suitably formulated for delivery into any desired part of the gastrointestinal tract. In addition, suitable suppositories may be used for delivery into the gastrointestinal tract.

The amino acid sequences, Nanobodies and polypeptides of the invention may also be administered intravenously or intraperitoneally by infusion or injection. Solutions of the amino acid sequences, Nanobodies and polypeptides of the invention or their salts can be prepared in water, optionally mixed with a nontoxic surfactant. Dispersions can also be prepared in glycerol, liquid polyethylene glycols, triacetin, and mixtures thereof and in oils. Under ordinary conditions of storage and use, these preparations contain a preservative to prevent the growth of microorganisms.

The pharmaceutical dosage forms suitable for injection or infusion can include sterile aqueous solutions or dispersions or sterile powders comprising the active ingredient which are adapted for the extemporaneous preparation of sterile injectable or infusible solutions or dispersions, optionally encapsulated in liposomes. In all cases, the ultimate dosage form must be sterile, fluid and stable under the conditions of manufacture and storage. The liquid carrier or vehicle can be a solvent or liquid dispersion medium comprising, for example, water, ethanol, a polyol (for example, glycerol, propylene glycol, liquid polyethylene glycols, and the like), vegetable oils, nontoxic glyceryl esters, and suitable mixtures thereof. The proper fluidity can be maintained, for example, by the formation of liposomes, by the maintenance of the required particle size in the case of dispersions or by the use of surfactants. The prevention of the action of microorganisms can be brought about by various antibacterial and antifungal agents, for example, parabens, chlorobutanol, phenol, sorbic acid, thimerosal, and the like. In many cases, it will be preferable to include isotonic agents, for example, sugars, buffers or sodium chloride. Prolonged absorption of the injectable compositions can be brought about by the use in the compositions of agents delaying absorption, for example, aluminum monostearate and gelatin.

Sterile injectable solutions are prepared by incorporating the amino acid sequences, Nanobodies and polypeptides of the invention in the required amount in the appropriate solvent with various of the other ingredients enumerated above, as required, followed by filter sterilization. In the case of sterile powders for the preparation of sterile injectable solutions, the preferred methods of preparation are vacuum drying and the freeze drying techniques, which yield a powder of the active ingredient plus any additional desired ingredient present in the previously sterile-filtered solutions.

For topical administration, the amino acid sequences, Nanobodies and polypeptides of the invention may be applied in pure form, i.e., when they are liquids. However, it will generally be desirable to administer them to the skin as compositions or formulations, in combination with a dermatologically acceptable carrier, which may be a solid or a liquid.

Useful solid carriers include finely divided solids such as talc, clay, microcrystalline cellulose, silica, alumina and the like. Useful liquid carriers include water, hydroxyalkyls or glycols or water-alcohol/glycol blends, in which the amino acid sequences, Nanobodies and polypeptides of the invention can be dissolved or dispersed at effective levels, optionally with the aid of non-toxic surfactants. Adjuvants such as fragrances and additional antimicrobial agents can be added to optimize the properties for a given use. The resultant liquid compositions can be applied from absorbent pads, used to impregnate bandages and other dressings, or sprayed onto the affected area using pump-type or aerosol sprayers.

Thickeners such as synthetic polymers, fatty acids, fatty acid salts and esters, fatty alcohols, modified celluloses or modified mineral materials can also be employed with liquid carriers to form spreadable pastes, gels, ointments, soaps, and the like, for application directly to the skin of the user.

Examples of useful dermatological compositions which can be used to deliver the amino acid sequences, Nanobodies and polypeptides of the invention to the skin are known to the art; for example, see Jacquet et al. (U.S. Pat. No. 4,608,392), Geria (U.S. Pat. No. 4,992,478), Smith et al. (U.S. Pat. No. 4,559,157) and Wortzman (U.S. Pat. No. 4,820,508).

Useful dosages of the amino acid sequences, Nanobodies and polypeptides of the invention can be determined by comparing their in vitro activity, and in vivo activity in animal models. Methods for the extrapolation of effective dosages in mice, and other animals, to humans are known to the art; for example, see U.S. Pat. No. 4,938,949.

Generally, the concentration of the amino acid sequences, Nanobodies and polypeptides of the invention in a liquid composition, such as a lotion, will be from about 0.1-25 wt-%, preferably from about 0.5-10 wt-%. The concentration in a semi-solid or solid composition such as a gel or a powder will be about 0.1-5 wt-%, preferably about 0.5-2.5 wt-%.

The amount of the amino acid sequences, Nanobodies and polypeptides of the invention required for use in treatment will vary not only with the particular amino acid sequence, Nanobody or polypeptide selected but also with the route of administration, the nature of the condition being treated and the age and condition of the patient and will be ultimately at the discretion of the attendant physician or clinician. Also the dosage of the amino acid sequences, Nanobodies and polypeptides of the invention varies depending on the target cell, tumor, tissue, graft, or organ.

The desired dose may conveniently be presented in a single dose or as divided doses administered at appropriate intervals, for example, as two, three, four or more sub-doses per day. The sub-dose itself may be further divided, e.g., into a number of discrete loosely spaced administrations; such as multiple inhalations from an insufflator or by application of a plurality of drops into the eye.

An administration regimen could include long-term, daily treatment. By "long-term" is meant at least two weeks and preferably, several weeks, months, or years of duration. Necessary modifications in this dosage range may be determined by one of ordinary skill in the art using only routine experimentation given the teachings herein. See Remington's Pharmaceutical Sciences (Martin, E. W., ed. 4), Mack Publishing Co., Easton, Pa. The dosage can also be adjusted by the individual physician in the event of any complication. In another aspect, the invention relates to a method for the prevention and/or treatment of at least one autoimmune disease, allergy, asthma, transplant rejection (acute and chronic), cancer, tumor, effector cell exhaustion, or infection, said method comprising administering, to a subject in need thereof, a pharmaceutically active amount of an amino acid sequence of the invention, of a Nanobody of the invention, of a polypeptide of the invention, and/or of a pharmaceutical composition comprising the same. In a preferred aspect, the invention relates to a method for the prevention and/or treatment of at least autoimmune diseases such as human anti-glomerular basement membrane (GBM) disease, lupus nephritis, diabetes, collagen-induced arthritis, autoimmune thyroiditis, autoimmune uveitis, psoriasis vulgaris, rheumatoid arthritis, CNS autoimmune diseases, multiple sclerosis, Graves disease, Myasthenia gravis (MG), Systemic lupus erythematosus (SLE), Immune thrombocytopenic purpura (ITP) and Psoriasis; allergy and asthma such as allergic contact dermatitis and airway hyperresponsiveness (bronchial asthma, allergic lung inflammatory responses); transplant rejections (acute and chronic) such as renal transplant rejection, bone marrow allograft rejection and cardiac allograft rejection; cancer and tumors; and viral infections.

In the context of the present invention, the term "prevention and/or treatment" not only comprises preventing and/or treating the disease, but also generally comprises preventing the onset of the disease, slowing or reversing the progress of disease, preventing or slowing the onset of one or more symptoms associated with the disease, reducing and/or alleviating one or more symptoms associated with the disease, reducing the severity and/or the duration of the disease and/or of any symptoms associated therewith and/or preventing a further increase in the severity of the disease and/or of any symptoms associated therewith, preventing, reducing or reversing any physiological damage caused by the disease, and generally any pharmacological action that is beneficial to the patient being treated.

The subject to be treated may be any warm-blooded animal, but is in particular a mammal, and more in particular a human being. As will be clear to the skilled person, the subject to be treated will in particular be a person suffering from, or at risk of, the diseases and disorders mentioned herein.

The invention relates to a method for the prevention and/or treatment of at least one disease or disorder that is associated with an APC target or a T-cell target, with its biological or pharmacological activity, and/or with the biological pathways or signalling in which an APC target or a T-cell target is involved, said method comprising administering, to a subject in need thereof, a pharmaceutically active amount of an amino acid sequence of the invention, of a Nanobody of the invention, of a polypeptide of the invention, and/or of a pharmaceutical composition comprising the same. In particular, the invention relates to a method for the prevention and/or treatment of at least one disease or disorder that can be treated by modulating an APC target or a T-cell target, its biological or pharmacological activity, and/or the biological pathways or signalling in which an APC target or a T-cell target is involved, said method comprising administering, to a subject in need thereof, a pharmaceutically active amount of an amino acid sequence of the invention, of a Nanobody of the invention, of a polypeptide of the invention, and/or of a pharmaceutical composition comprising the same. In particular, said pharmaceutically effective amount may be an amount that is sufficient to modulate the APC target or T-cell target, its biological or pharmacological activity, and/or the biological pathways or signalling in which the APC target or T-cell target is involved; and/or an amount that provides a level of the amino acid sequence of the invention, of a Nanobody of the invention, of a polypeptide of the invention in the circulation that is sufficient to modulate the APC target or T-cell target, its biological or pharmacological activity, and/or the biological pathways or signalling in which the APC target or T-cell target is involved; and/or an amount that provides a level of the amino acid sequence of the invention, of a Nanobody of the invention, of a polypeptide of the invention in the circulation that is sufficient to increase or decrease T-cell survival and/or differentiation of naive T-cells into activated cytokine secreting T-cells.

The invention furthermore relates to a method for the prevention and/or treatment of at least one disease or disorder that can be prevented and/or treated by administering an amino acid sequence of the invention, a Nanobody of the invention or a polypeptide of the invention to a patient, said method comprising administering, to a subject in need thereof, a pharmaceutically active amount of an amino acid sequence of the invention, of a Nanobody of the invention, of a polypeptide of the invention, and/or of a pharmaceutical composition comprising the same.

More in particular, the invention relates to a method for the prevention and/or treatment of at least one disease or disorder chosen from the group consisting of the diseases and disorders listed herein, said method comprising administering, to a subject in need thereof, a pharmaceutically active amount of an amino acid sequence of the invention, of a Nanobody of the invention, of a polypeptide of the invention, and/or of a pharmaceutical composition comprising the same.

In another aspect, the invention relates to a method for immunotherapy, and in particular for passive immunotherapy, which method comprises administering, to a subject suffering from or at risk of the diseases and disorders mentioned herein, a pharmaceutically active amount of an amino acid sequence of the invention, of a Nanobody of the invention, of a polypeptide of the invention, and/or of a pharmaceutical composition comprising the same.

In the above methods, the amino acid sequences, Nanobodies and/or polypeptides of the invention and/or the compositions comprising the same can be administered in any suitable manner, depending on the specific pharmaceutical formulation or composition to be used. Thus, the amino acid sequences, Nanobodies and/or polypeptides of the invention and/or the compositions comprising the same can for example be administered orally, intraperitoneally (e.g. intravenously, subcutaneously, intramuscularly, or via any other route of administration that circumvents the gastrointestinal tract), intranasally, transdermally, topically, by means of a suppository, by inhalation, again depending on the specific pharmaceutical formulation or composition to be used. The clinician will be able to select a suitable route of administration and a suitable pharmaceutical formulation or composition to be used in such administration, depending on the disease or disorder to be prevented or treated and other factors well known to the clinician.

The amino acid sequences, Nanobodies and/or polypeptides of the invention and/or the compositions comprising the same are administered according to a regime of treatment that is suitable for preventing and/or treating the disease or disorder to be prevented or treated. The clinician will generally be able to determine a suitable treatment regimen, depending on factors such as the disease or disorder to be prevented or treated, the severity of the disease to be treated and/or the severity of the symptoms thereof, the specific amino acid sequence, Nanobody or polypeptide of the invention to be used, the specific route of administration and pharmaceutical formulation or composition to be used, the age, gender, weight, diet, general condition of the patient, and similar factors well known to the clinician.

Generally, the treatment regimen will comprise the administration of one or more amino acid sequences, Nanobodies and/or polypeptides of the invention, or of one or more compositions comprising the same, in one or more pharmaceutically effective amounts or doses. The specific amount(s) or doses to administered can be determined by the clinician, again based on the factors cited above.

Generally, for the prevention and/or treatment of the diseases and disorders mentioned herein and depending on the specific disease or disorder to be treated, the potency of the specific amino acid sequence, Nanobody and polypeptide of the invention to be used, the specific route of administration and the specific pharmaceutical formulation or composition used, the amino acid sequences, Nanobodies and polypeptides of the invention will generally be administered in an amount between 1 gram and 0.01 microgram per kg body weight per day, preferably between 0.1 gram and 0.1 microgram per kg body weight per day, such as about 1, 10, 100 or 1000 microgram per kg body weight per day, either continuously (e.g. by infusion), as a single daily dose or as multiple divided doses during the day. The clinician will generally be able to determine a suitable daily dose, depending on the factors mentioned herein. It will also be clear that in specific cases, the clinician may choose to deviate from these amounts, for example on the basis of the factors cited above and his expert judgment. Generally, some guidance on the amounts to be administered can be obtained from the amounts usually administered for comparable conventional antibodies or antibody fragments against the same target administered via essentially the same route, taking into account however differences in affinity/avidity, efficacy, biodistribution, half-life and similar factors well known to the skilled person.

Usually, in the above method, a single amino acid sequence, Nanobody or polypeptide of the invention will be used. It is however within the scope of the invention to use two or more amino acid sequences, Nanobodies and/or polypeptides of the invention in combination.

The Nanobodies, amino acid sequences and polypeptides of the invention may also be used in combination with one or more further pharmaceutically active compounds or principles, i.e. as a combined treatment regimen, which may or may not lead to a synergistic effect. Again, the clinician will be able to select such further compounds or principles, as well as a suitable combined treatment regimen, based on the factors cited above and his expert judgement.

In particular, the amino acid sequences, Nanobodies and polypeptides of the invention may be used in combination with other pharmaceutically active compounds or principles that are or can be used for the prevention and/or treatment of the diseases and disorders cited herein, as a result of which a synergistic effect may or may not be obtained. Examples of such compounds and principles, as well as routes, methods and pharmaceutical formulations or compositions for administering them will be clear to the clinician.

In one aspect of the invention, the amino acid sequences, Nanobodies and polypeptides of the invention are used in combination with another pharmaceutically active compound or principles for the prevention and/or treatment of autoimmune diseases, allergy and asthma, transplant rejections (acute and chronic), cancer and tumors, effector cell exhaustion and/or infections. For example, in one embodiment, the amino acid sequences, Nanobodies and polypeptides of the invention that are directed against CTLA4 or PD-1 are used in combination with tumor vaccination. In another embodiment, the amino acid sequences, Nanobodies and polypeptides of the invention that are directed against B7-1 and/or B7-2 are used in combination with other pharmaceutically active compounds or principles for the prevention and/or treatment of autoimmune diseases, allergy and asthma and/or transplant rejections (acute and chronic).

When two or more substances or principles are to be used as part of a combined treatment regimen, they can be administered via the same route of administration or via different routes of administration, at essentially the same time or at different times (e.g. essentially simultaneously, consecutively, or according to an alternating regime). When the substances or principles are to be administered simultaneously via the same route of administration, they may be administered as different pharmaceutical formulations or compositions or part of a combined pharmaceutical formulation or composition, as will be clear to the skilled person.

Also, when two or more active substances or principles are to be used as part of a combined treatment regimen, each of the substances or principles may be administered in the same amount and according to the same regimen as used when the compound or principle is used on its own, and such combined use may or may not lead to a synergistic effect. However, when the combined use of the two or more active substances or principles leads to a synergistic effect, it may also be possible to reduce the amount of one, more or all of the substances or principles to be administered, while still achieving the desired therapeutic action. This may for example be useful for avoiding, limiting or reducing any unwanted side-effects that are associated with the use of one or more of the substances or principles when they are used in their usual amounts, while still obtaining the desired pharmaceutical or therapeutic effect.

The effectiveness of the treatment regimen used according to the invention may be determined and/or followed in any manner known per se for the disease or disorder involved, as will be clear to the clinician. The clinician will also be able, where appropriate and on a case-by-case basis, to change or modify a particular treatment regimen, so as to achieve the desired therapeutic effect, to avoid, limit or reduce unwanted side-effects, and/or to achieve an appropriate balance between achieving the desired therapeutic effect on the one hand and avoiding, limiting or reducing undesired side effects on the other hand.

Generally, the treatment regimen will be followed until the desired therapeutic effect is achieved and/or for as long as the desired therapeutic effect is to be maintained. Again, this can be determined by the clinician.

In another aspect, the invention relates to the use of an amino acid sequence, Nanobody or polypeptide of the invention in the preparation of a pharmaceutical composition for prevention and/or treatment of at least one autoimmune disease, allergy, asthma, transplant rejection (acute and chronic), cancer, tumor, effector cell exhaustion, or infection; and/or for use in one or more of the methods of treatment mentioned herein. In a preferred aspect, the invention relates to the use of an amino acid sequence, Nanobody or polypeptide of the invention in the preparation of a pharmaceutical composition for prevention and/or treatment of at least autoimmune diseases such as human anti-glomerular basement membrane (GBM) disease, lupus nephritis, diabetes, collagen-induced arthritis, autoimmune thyroiditis, autoimmune uveitis, psoriasis vulgaris, rheumatoid arthritis, CNS autoimmune diseases, multiple sclerosis, Graves disease, Myasthenia gravis (MG), Systemic lupus erythematosus (SLE), Immune thrombocytopenic purpura (ITP) and Psoriasis; allergy and asthma such as allergic contact dermatitis and airway hyperresponsiveness (bronchial asthma, allergic lung inflammatory responses); transplant rejections (acute and chronic) such as renal transplant rejection, bone marrow allograft rejection and cardiac allograft rejection; cancer and tumors; and viral infections.

The subject to be treated may be any warm-blooded animal, but is in particular a mammal, and more in particular a human being. As will be clear to the skilled person, the subject to be treated will in particular be a person suffering from, or at risk of, the diseases and disorders mentioned herein.

The invention also relates to the use of an amino acid sequence, Nanobody or polypeptide of the invention in the preparation of a pharmaceutical composition for the prevention and/or treatment of at least one disease or disorder that can be prevented and/or treated by administering an amino acid sequence, Nanobody or polypeptide of the invention to a patient.

More in particular, the invention relates to the use of an amino acid sequence, Nanobody or polypeptide of the invention in the preparation of a pharmaceutical composition for the prevention and/or treatment of autoimmune diseases, allergies, asthma, transplant rejections (acute and chronic), cancers, tumors, effector cell exhaustion, or infections, and in particular for the prevention and treatment of one or more of the diseases and disorders listed herein.

Again, in such a pharmaceutical composition, the one or more amino acid sequences, Nanobodies or polypeptides of the invention may also be suitably combined with one or more other active principles, such as those mentioned herein.

Finally, although the use of the Nanobodies of the invention (as defined herein) and of the polypeptides of the invention is much preferred, it will be clear that on the basis of the description herein, the skilled person will also be able to design and/or generate, in an analogous manner, other amino acid sequences and in particular (single) domain antibodies against an APC target or T-cell target, as well as polypeptides comprising such (single) domain antibodies.

For example, it will also be clear to the skilled person that it may be possible to "graft" one or more of the CDR's mentioned above for the Nanobodies of the invention onto such (single) domain antibodies or other protein scaffolds, including but not limited to human scaffolds or non-immunoglobulin scaffolds. Suitable scaffolds and techniques for such CDR grafting will be clear to the skilled person and are well known in the art, see for example U.S. Pat. No. 7,180,370, WO 01/27160, EP 0 605 522, EP 0 460 167, U.S. Pat. No. 7,054,297, Nicaise et al., Protein Science (2004), 13:1882-1891; Ewert et al., Methods, 2004 October; 34(2):184-199; Kettleborough et al., Protein Eng. 1991 October; 4(7): 773-783; O'Brien and Jones, Methods Mol. Biol. 2003:207:81-100; Skerra, J. Mol. Recognit. 2000:13:167-187, and Saerens et al., J. Mol. Biol. 2005 Sep. 23; 352(3):597-607, and the further references cited therein. For example, techniques known per se for grafting mouse or rat CDR's onto human frameworks and scaffolds can be used in an analogous manner to provide chimeric proteins comprising one or more of the CDR's of the Nanobodies of the invention and one or more human framework regions or sequences.

It should also be noted that, when the Nanobodies of the inventions contain one or more other CDR sequences than the preferred CDR sequences mentioned above, these CDR sequences can be obtained in any manner known per se, for example from Nanobodies (preferred), $V_H$ domains from conventional antibodies (and in particular from human antibodies), heavy chain antibodies, conventional 4-chain antibodies (such as conventional human 4-chain antibodies) or other immunoglobulin sequences directed against an APC target or T-cell target. Such immunoglobulin sequences directed against an APC target or T-cell target can be generated in any manner known per se, as will be clear to the skilled person, i.e. by immunization with an APC target or T-cell target or by screening a suitable library of immunoglobulin sequences with an APC target or T-cell target, or any suitable combination thereof. Optionally, this may be followed by techniques such as random or site-directed mutagenesis and/or other techniques for affinity maturation known per se. Suitable techniques for generating such immunoglobulin sequences will be clear to the skilled person, and for example include the screening techniques reviewed by Hoogenboom, Nature Biotechnology, 23, 9, 1105-1116 (2005) Other techniques for generating immunoglobulins against a specified target include for example the Nanoclone technology (as for example described in the published US patent application 2006-0211088), so-called SLAM technology (as for example described in the European patent application 0 542 810), the use of transgenic mice expressing human immunoglobulins or the well-known hybridoma techniques (see for example Larrick et al, Biotechnology, Vol. 7, 1989, p. 934). All these techniques can be used to generate immunoglobulins against an APC target or T-cell target, and the CDR's of such immunoglobulins can be used in the Nanobodies of the invention, i.e. as outlined above. For example, the sequence of such a CDR can be determined, synthesized and/or isolated, and inserted into the sequence of a Nanobody of the invention (e.g. so as to replace the corresponding native CDR), all using techniques known per se such as those described herein, or Nanobodies of the invention containing such CDR's (or nucleic acids encoding the same) can be synthesized de novo, again using the techniques mentioned herein.

Further uses of the amino acid sequences, Nanobodies, polypeptides, nucleic acids, genetic constructs and hosts and host cells of the invention will be clear to the skilled person based on the disclosure herein. For example, and without limitation, the amino acid sequences of the invention can be linked to a suitable carrier or solid support so as to provide a medium than can be used in a manner known per se to purify an APC target or T-cell target from compositions and preparations comprising the same. Derivatives of the amino acid sequences of the invention that comprise a suitable detectable label can also be used as markers to determine (qualitatively or quantitatively) the presence of an APC target or T-cell target in a composition or preparation or as a marker to selectively detect the presence of an APC target or T-cell target on the surface of a cell or tissue (for example, in combination with suitable cell sorting techniques).

The invention will now be further described by means of the following non-limiting examples and figures, in which the Figures show:

FIGURE LEGENDS

FIG. 1: Overview of B7:CD28 superfamily. Receptors, ligands, and their interactions are shown. From Sharpe and Freeman (Nat. Rev. Immunol. 2(2): 116-26, 2002).

Figure 2:
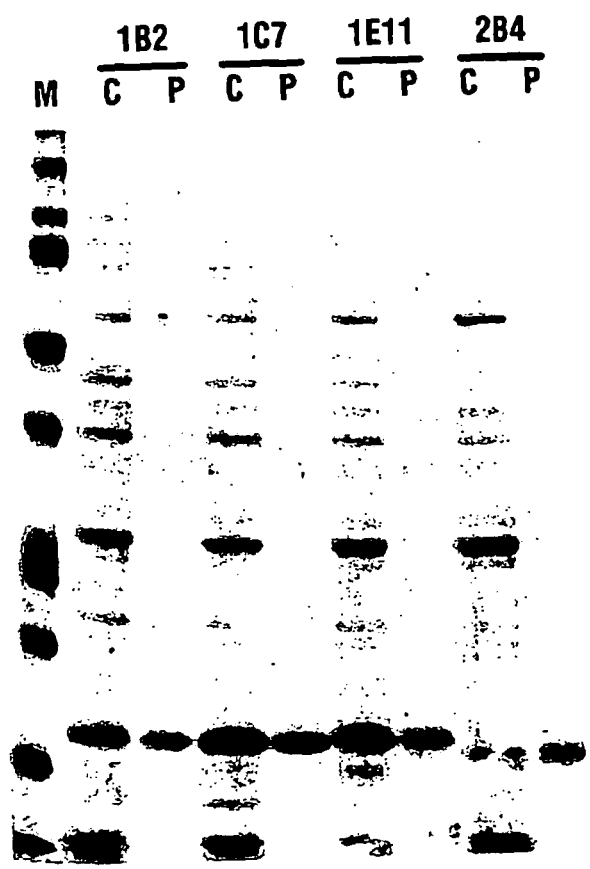

FIG. 2: SDS-PAGE analysis of purified Nanobodie against B7-1 and/or B7-2. M=MW marker ladder, C=crude extract, P=purified protein, top of bar=clone identification codes.

Figure 3:
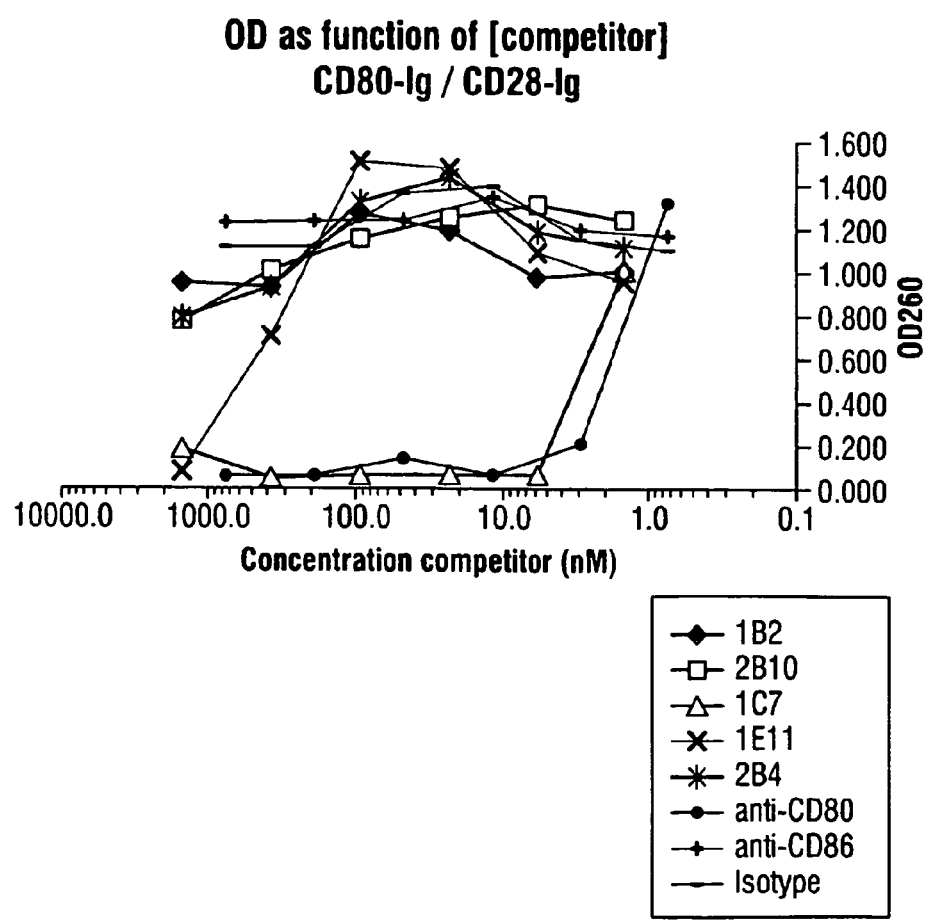

FIG. 3: Titration of inhibitory and non-inhibitory CD80 and/or CD86 binding Nanobodies in competion ELISA: binding of CD80-Ig with CD28-Ig is inhibited by the CD80 or CD86 binding Nanobodies as described in example 7.

Figure 4:
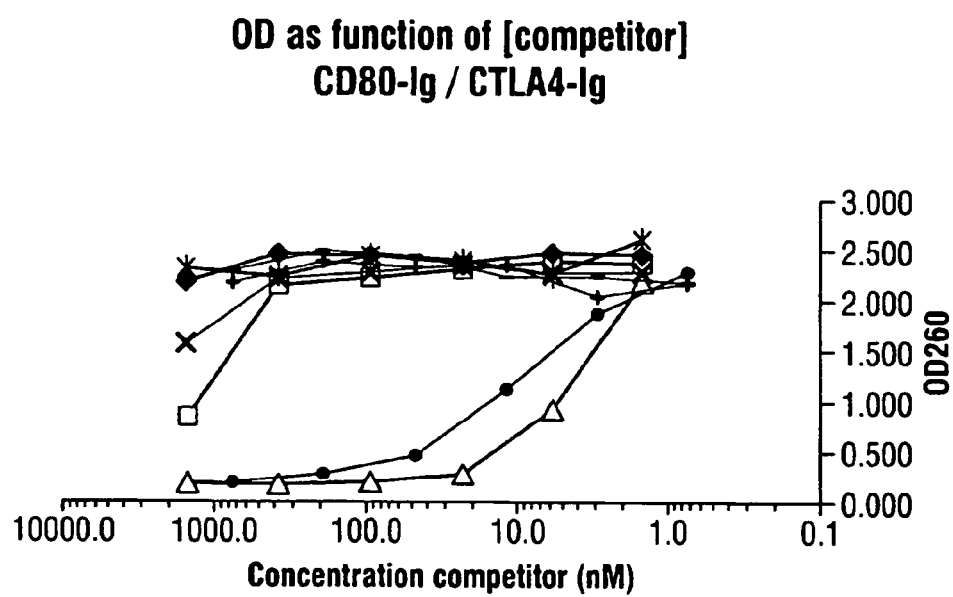

FIG. 4: Titration of inhibitory and non-inhibitory CD80 and/or CD86 binding Nanobodies in competion ELISA: binding of CD80-Ig with CTLA4-Ig is competed by the CD80 and/or CD86 binding Nanobodies as described in example 7. Legend to the different curves is as depicted in FIG. 3.

Figure 5:
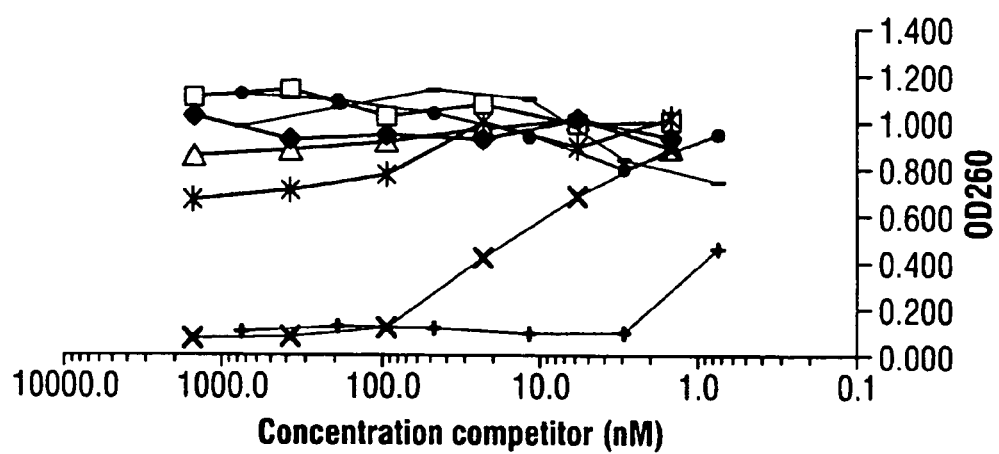

FIG. 5: Titration of inhibitory and non-inhibitory CD80 and/or CD86 binding Nanobodies in competion ELISA: binding of CD86-Ig with CD28-Ig is competed by the CD80 and/or CD86 binding Nanobodies as described in example 7. Legend to the different curves is as depicted in FIG. 3.

Figure 6:
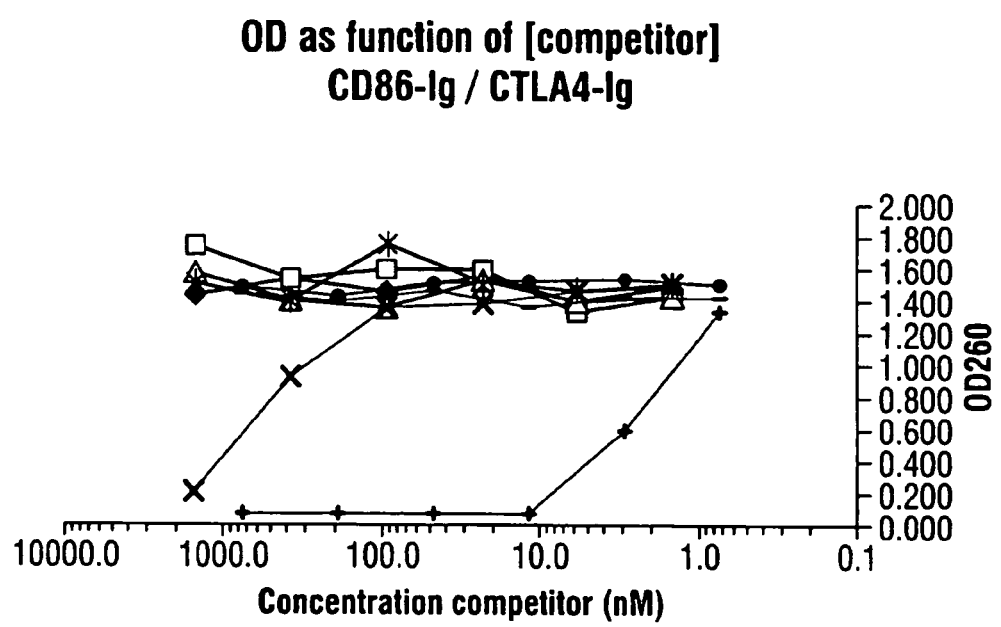

FIG. 6: Titration of inhibitory and non-inhibitory CD80 and/or CD86 binding Nanobodies in competion ELISA: binding of CD86-Ig with CTLA4-Ig is competed by the CD80 and/or CD86 binding Nanobodies as described in example 7. Legend to the different curves is as depicted in FIG. 3.

Figure 7:
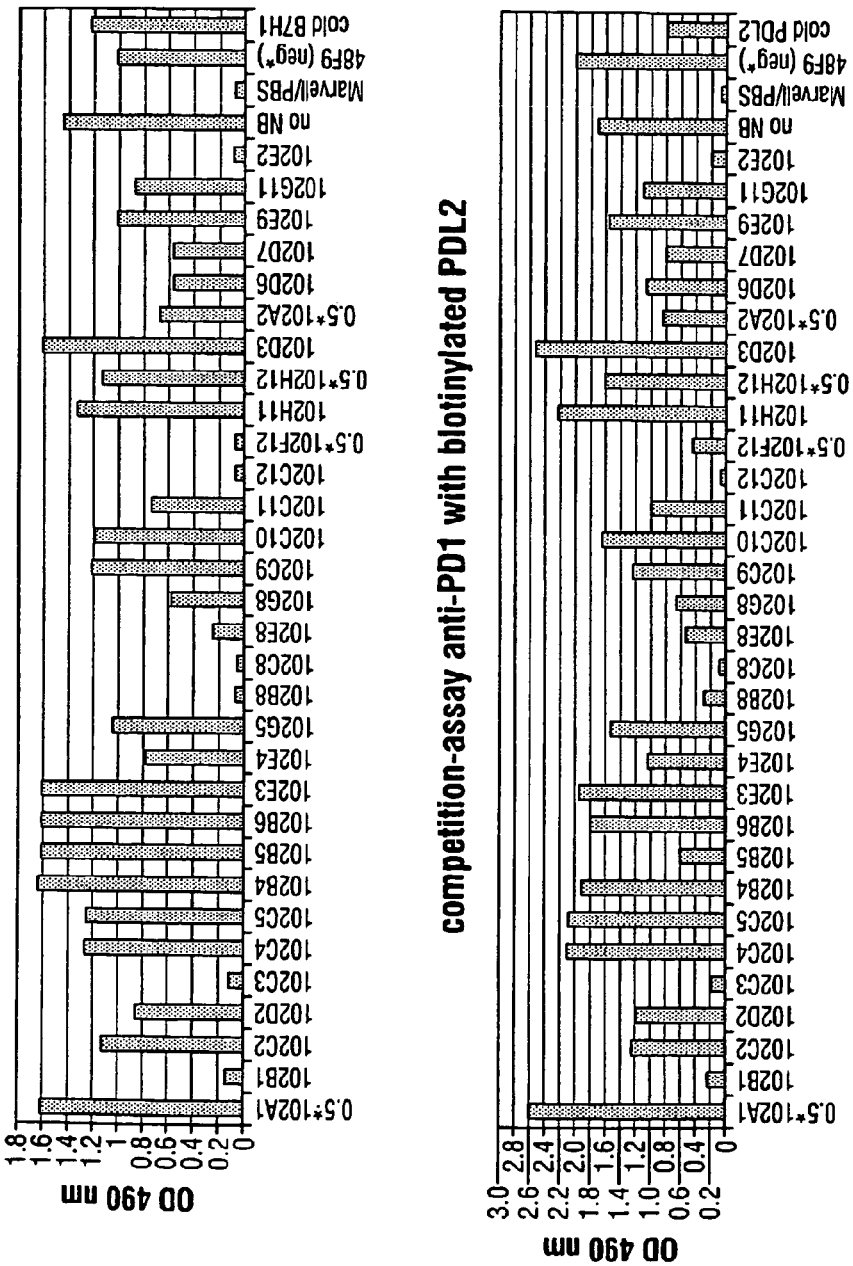

FIG. 7: OD values obtained in competition ELISA: PD-1 binding Nanobodies compete with B7H1 (PD-L1) or PD-L2 for binding PD-1, as described in Example 15.

Figure 8:
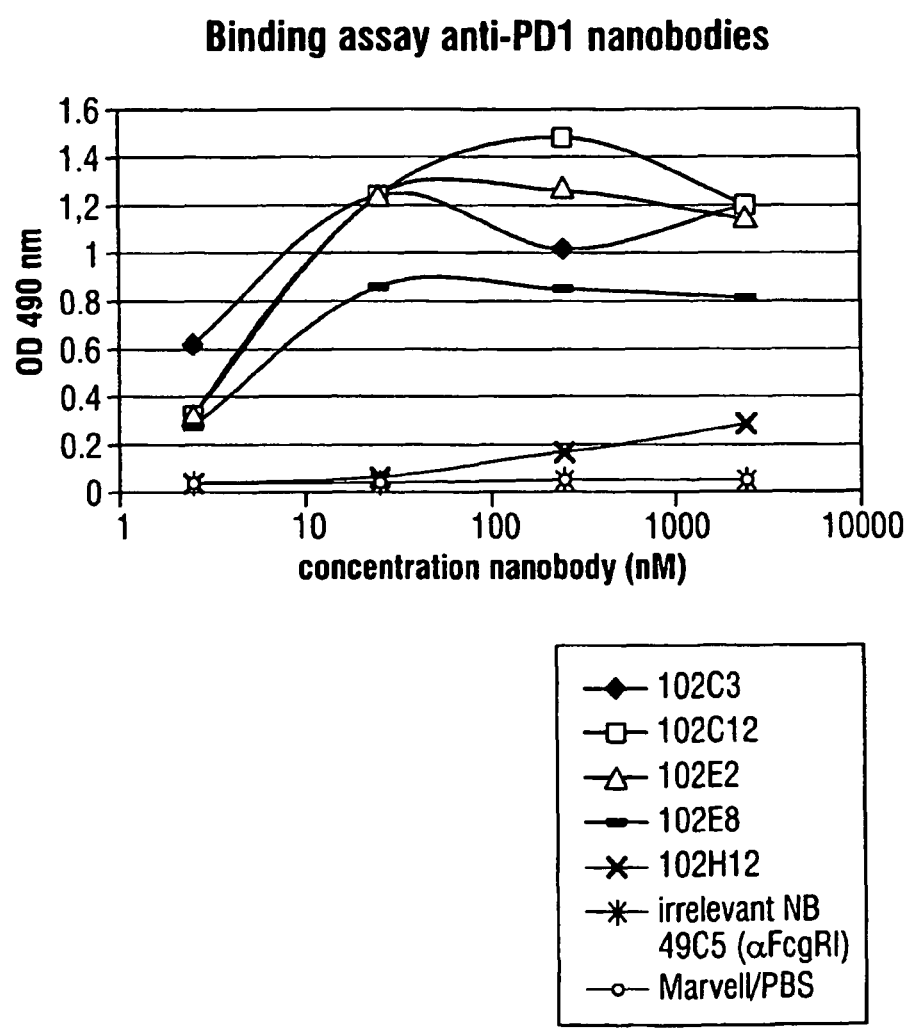

FIG. 8: Binding of selected PD-1 binding Nanobodies to PD-1 in ELISA.

Figure 9:
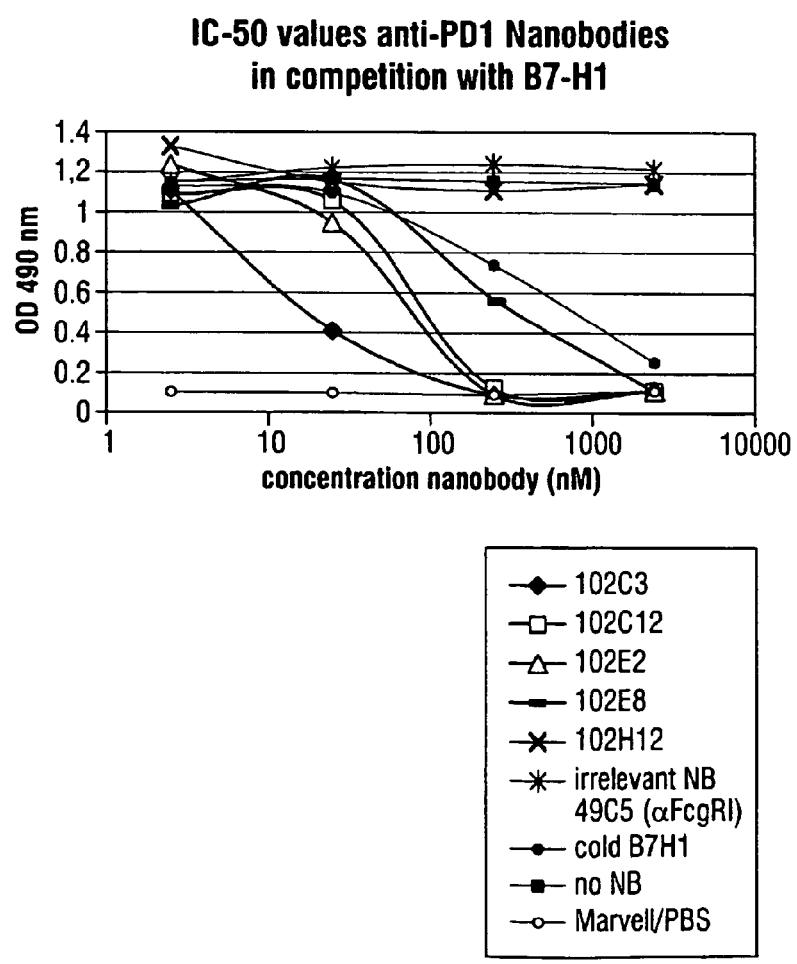

FIG. 9: OD values obtained in competition ELISA: PD-1 binding Nanobodies compete with B7H1 (PD-L1) for binding to PD-1, as described in Example 16.

Figure 10:
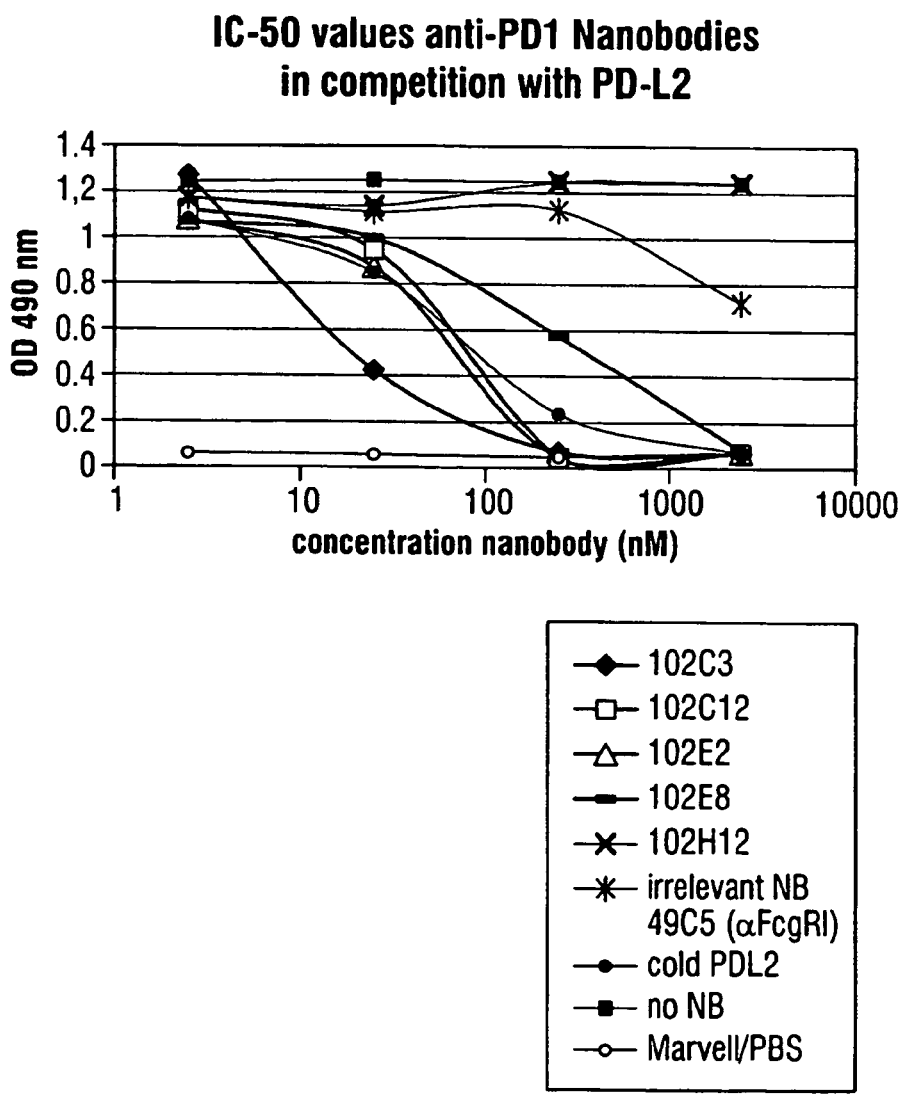

FIG. 10: OD values obtained in competition ELISA: PD-1 binding Nanobodies compete with PD-L2 for binding to PD-1, as described in Example 16.

Figure 11:
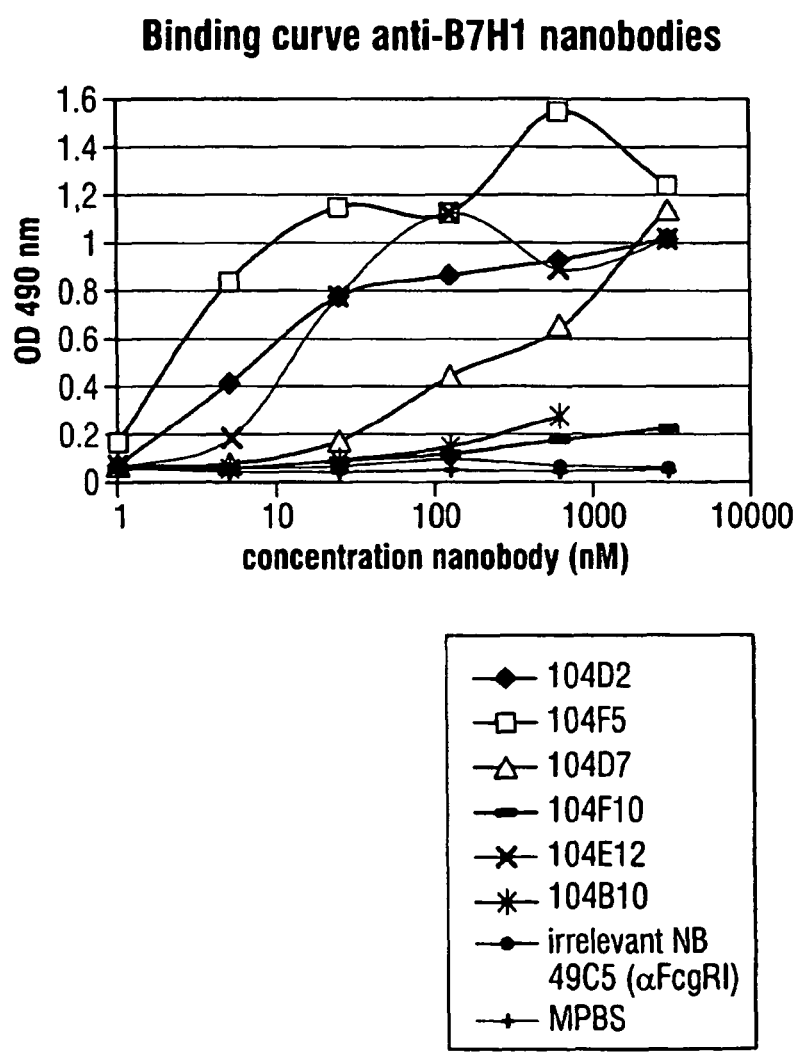

FIG. 11: Binding of selected B7-H1 binding Nanobodies to B7-H1 in ELISA.

Figure 12:
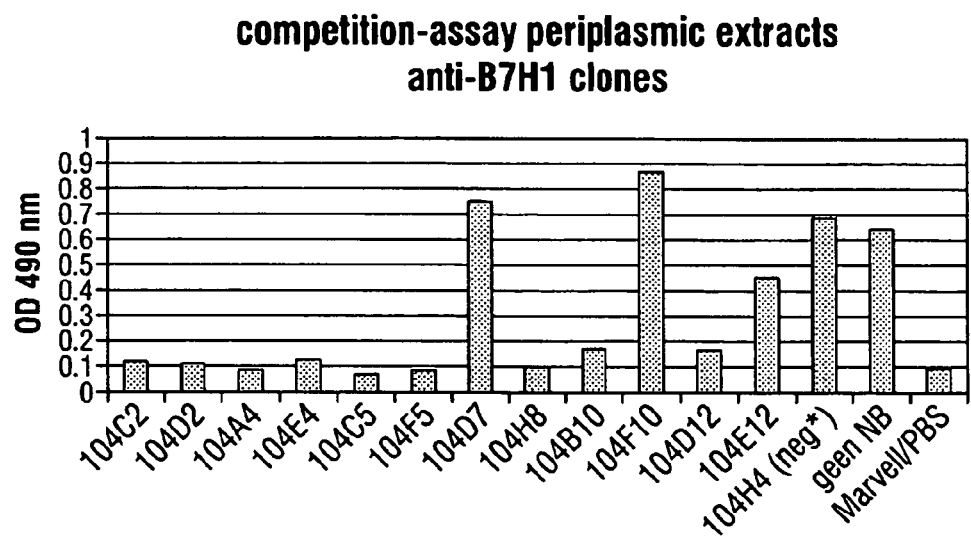

FIG. 12: OD values obtained in competition ELISA: B7-H1 (PD-L1) binding Nanobodies compete with PD-1 for binding B7-H1, as described in Example 21.

Figure 13:
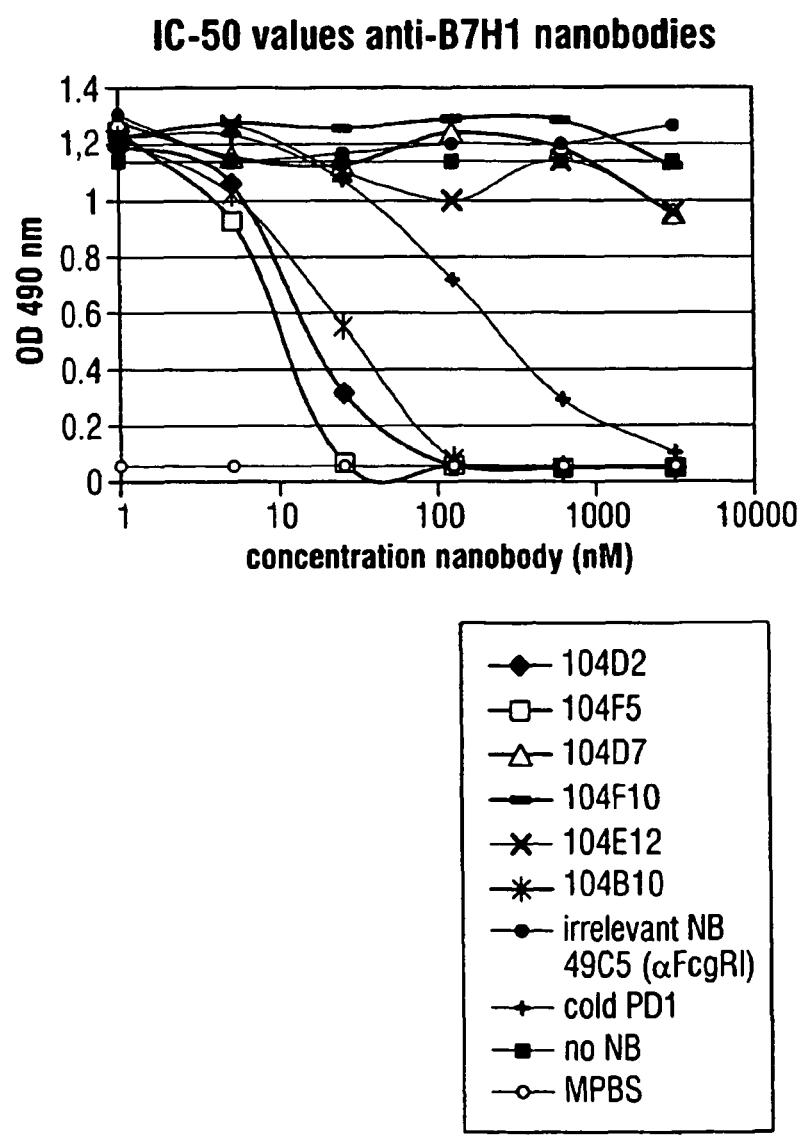

FIG. 13: OD values obtained in competition ELISA: B7-H1 binding Nanobodies compete with PD-1 for binding to B7-H1, as described in Example 22.

Figure 14:
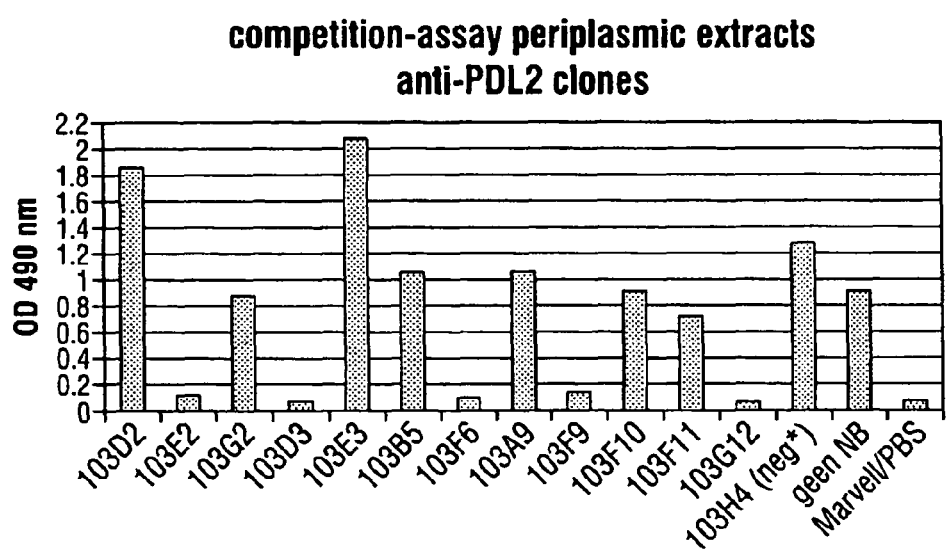

FIG. 14: OD values obtained in competition ELISA: PD-L2 binding Nanobodies compete with PD-1 for binding to PD-L2, as described in Example 27.

Figure 15:
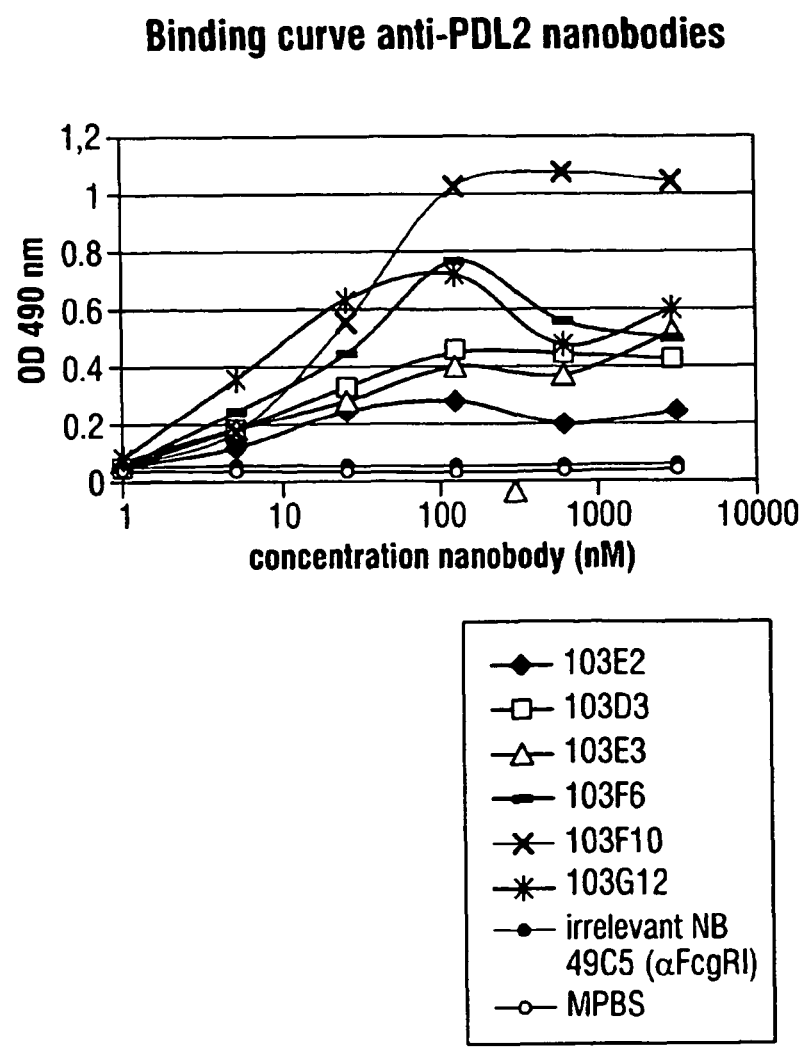

FIG. 15: Binding of selected PD-L2 binding Nanobodies to PD-L2 in ELISA.

Figure 16:
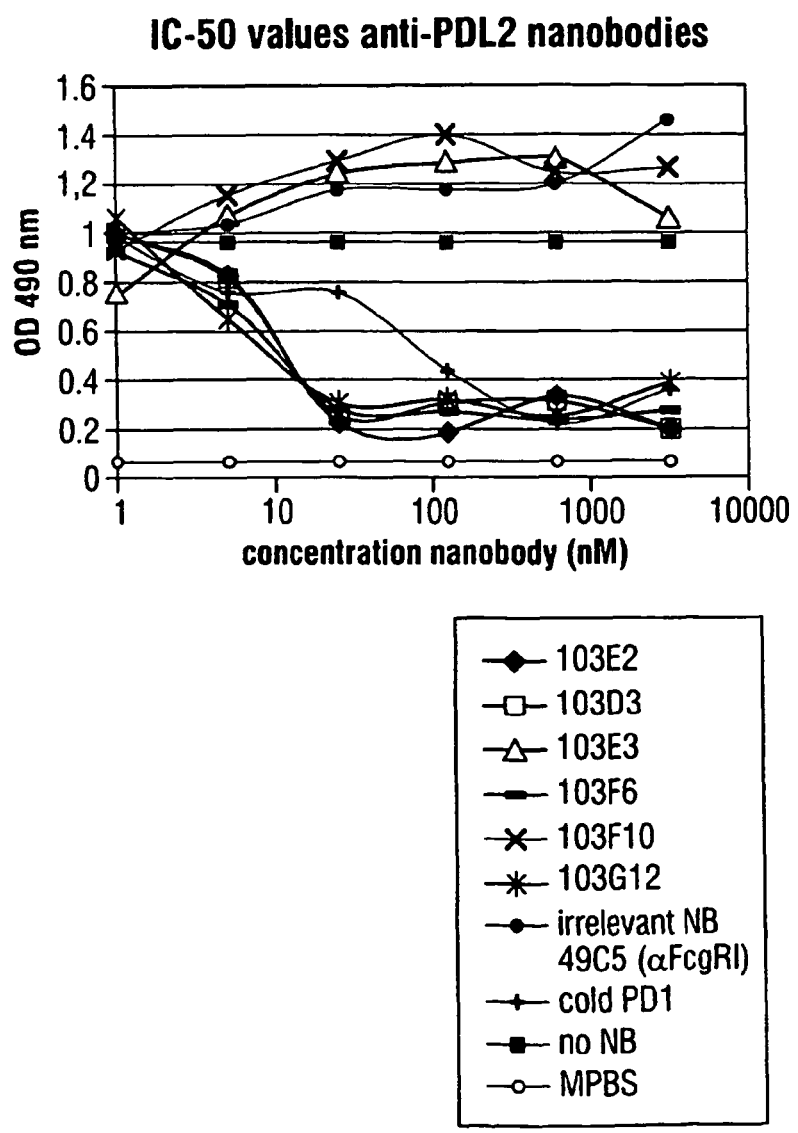

FIG. 16: OD values obtained in competition ELISA: PD-L2 binding Nanobodies compete with PD-1 for binding to PD-L2, as described in Example 28.

Figure 17:
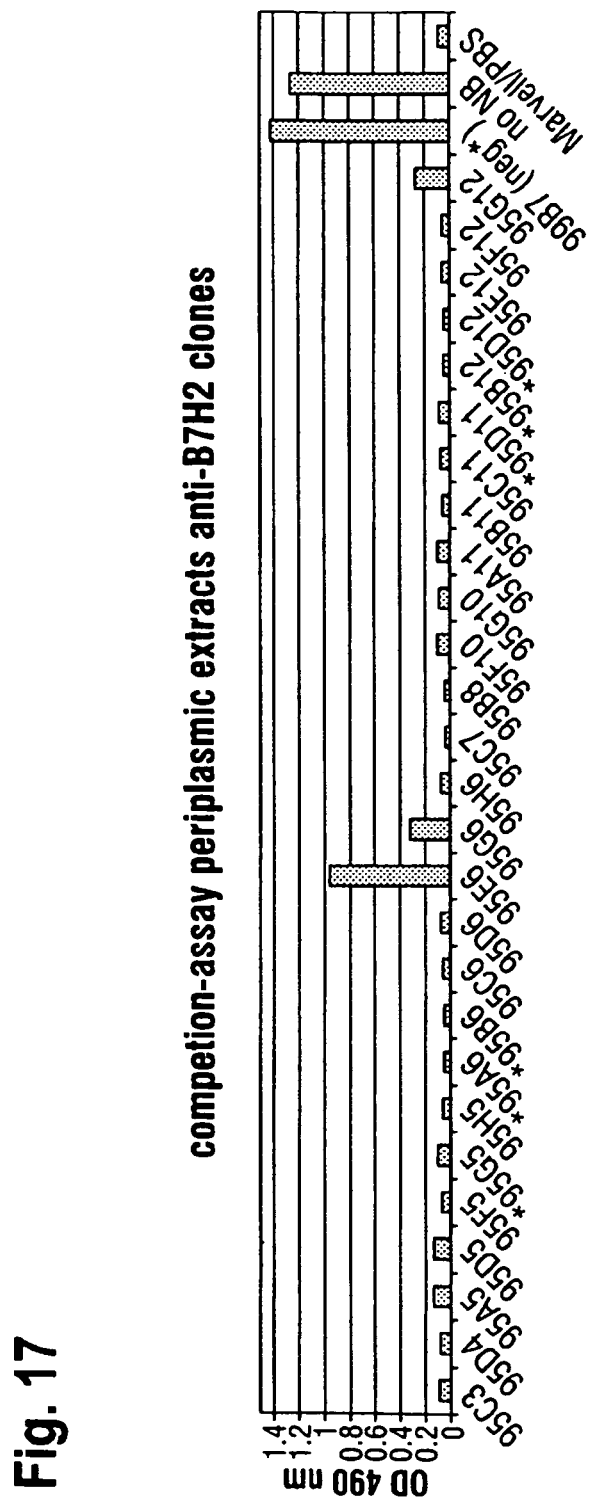

FIG. 17: OD values obtained in competition ELISA: B7-H2 binding Nanobodies compete with ICOS for binding to B7-H2, as described in Example 33.

Figure 18:
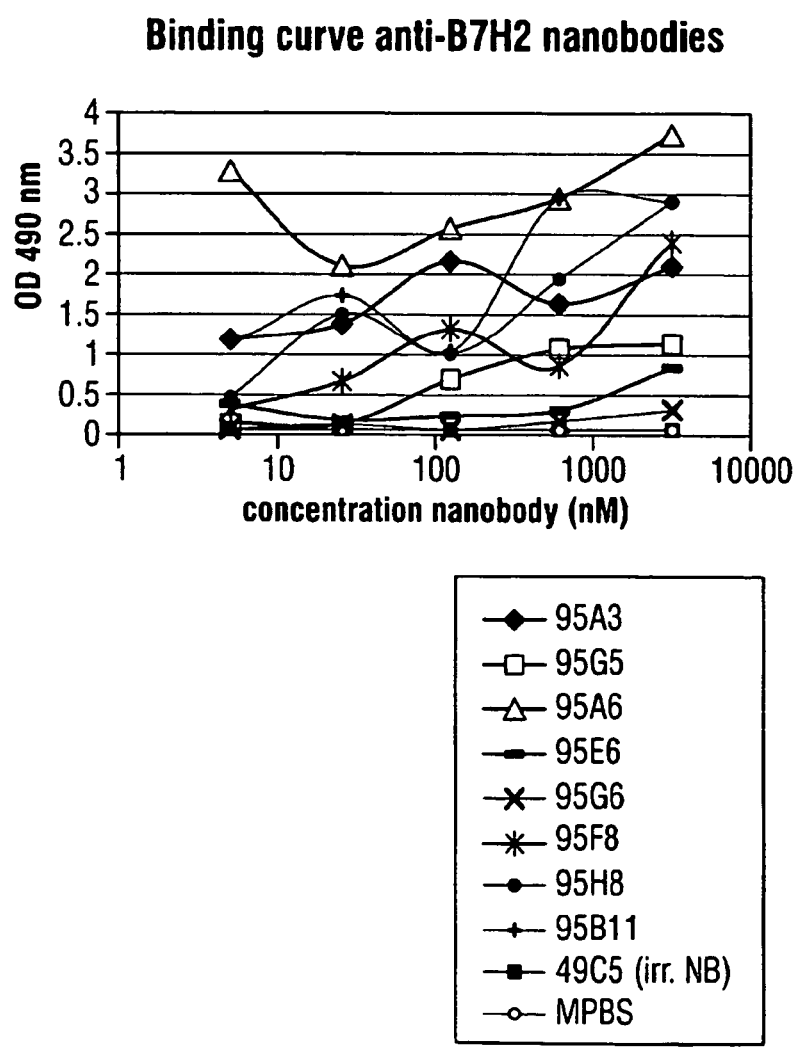

FIG. 18: Binding of selected B7-H2 binding Nanobodies to B7-H2 in ELISA.

Figure 19:
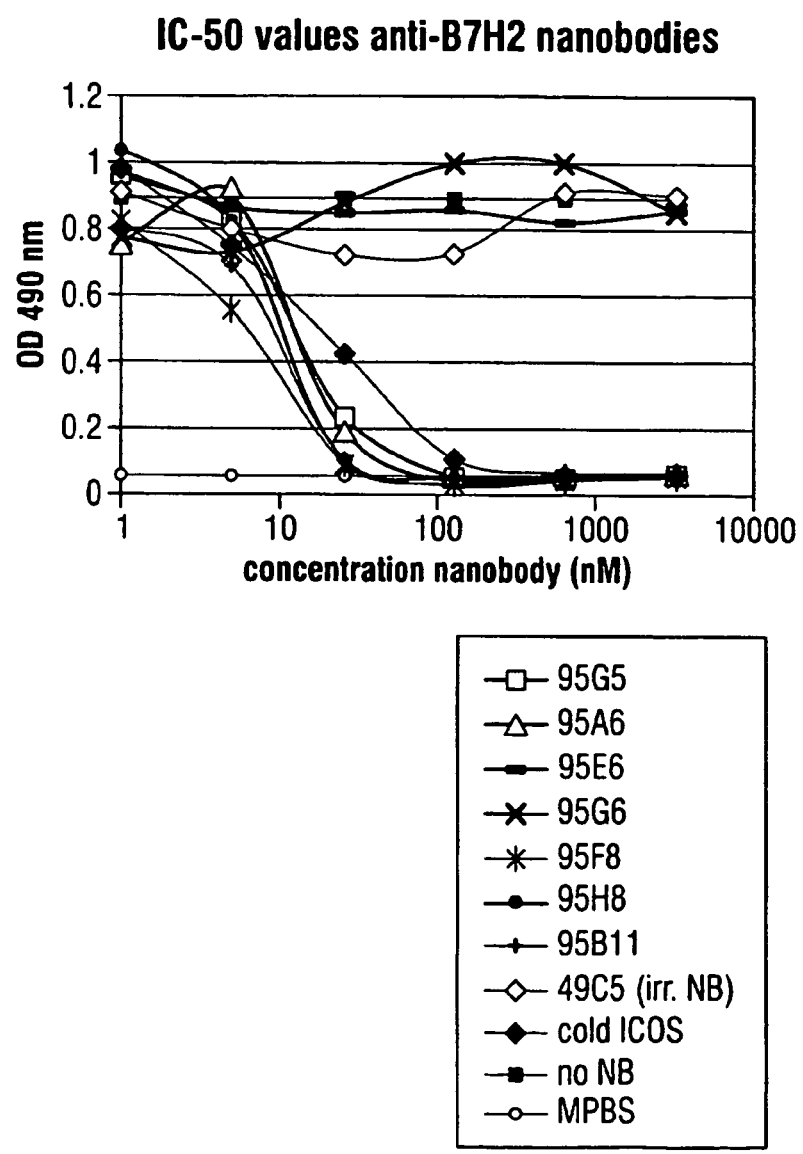

FIG. 19: OD values obtained in competition ELISA: B7-H2 binding Nanobodies compete with ICOS for binding to B7-H2, as described in Example 34.

Figure 20:
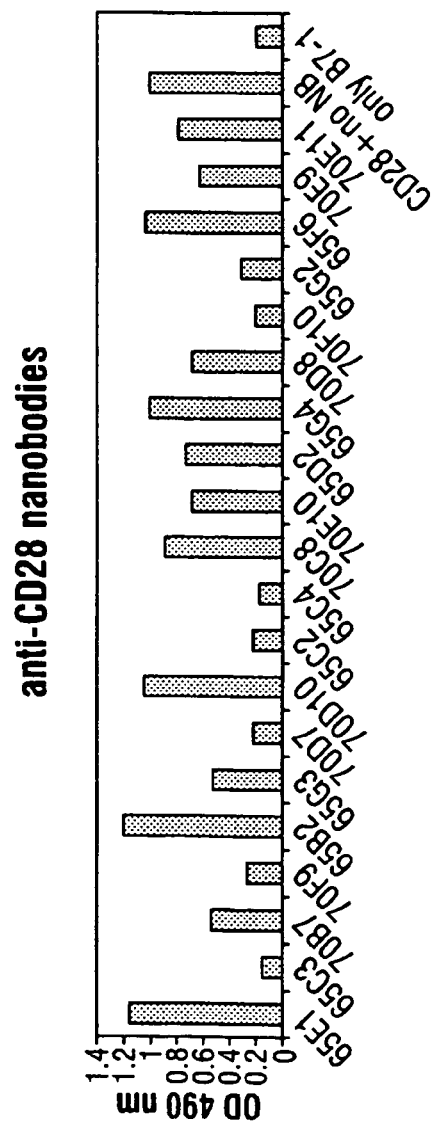

FIG. 20: OD values obtained in competition ELISA: CD28 binding Nanobodies compete with B7-1 for binding to CD28, as described in Example 39.

Figure 21:
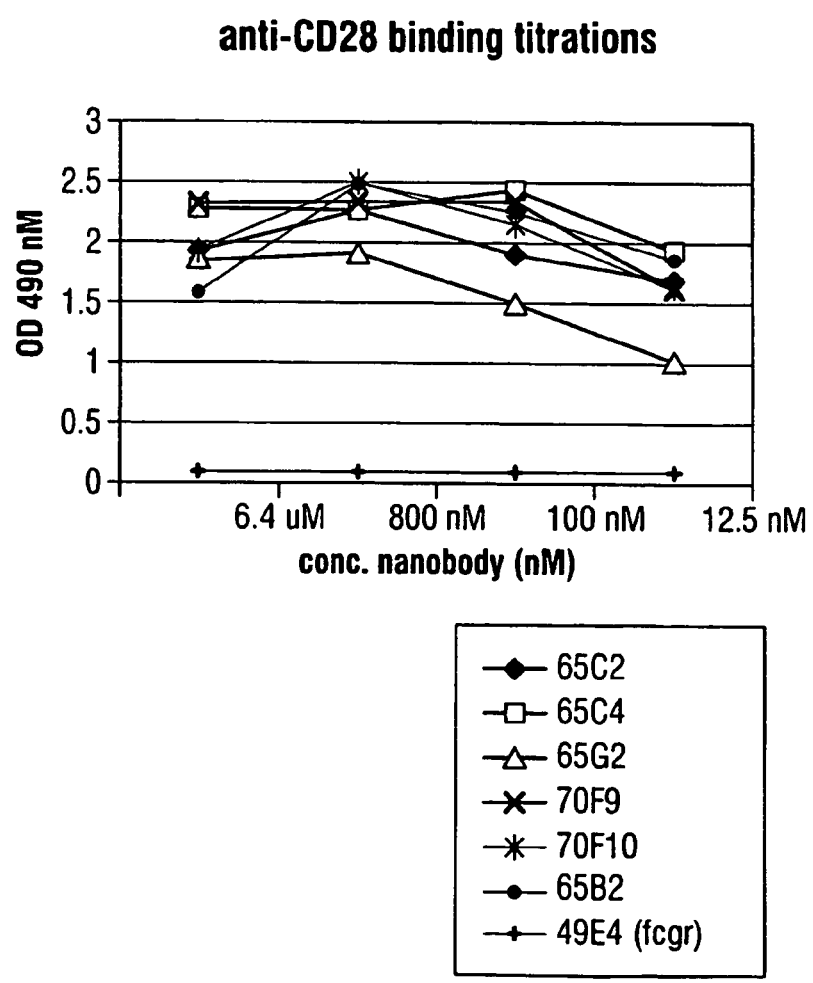

FIG. 21: Binding of selected CD28 binding Nanobodies to CD28 in ELISA.

Figure 22:
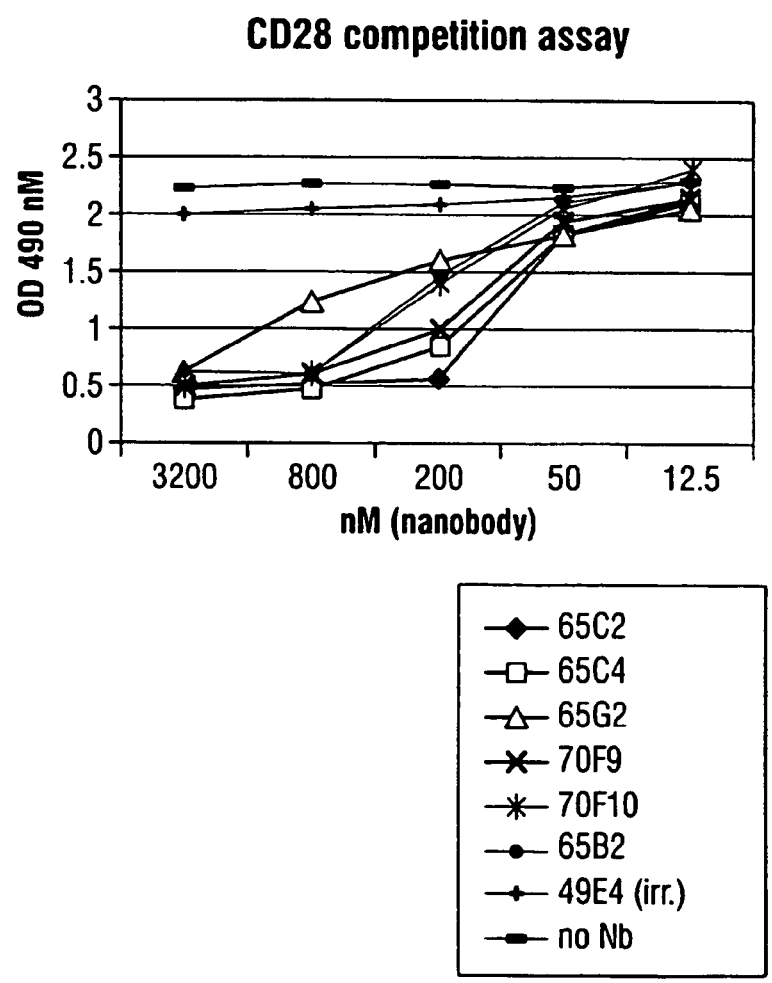

FIG. 22: OD values obtained in competition ELISA: CD28 binding Nanobodies compete with B7-1 for binding to CD28, as described in Example 40.

Figure 23:
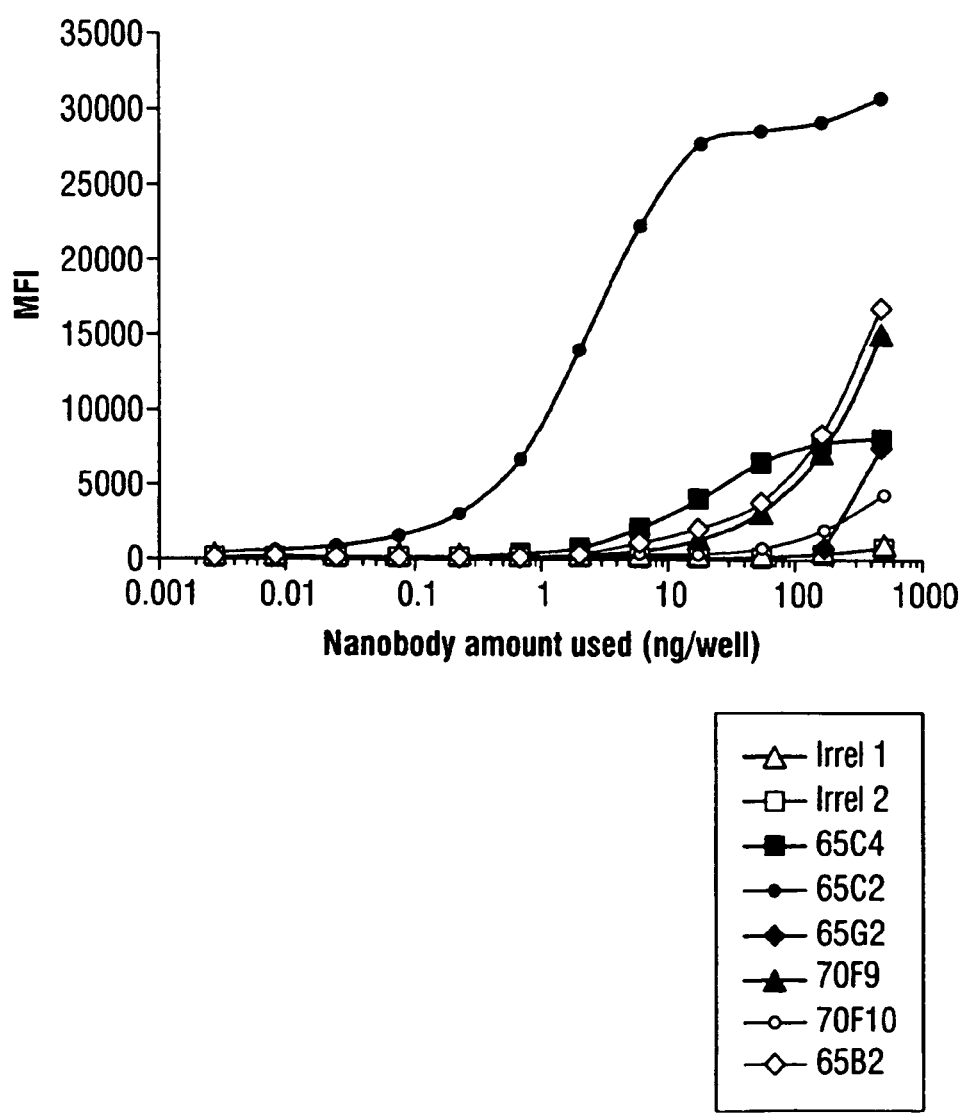

FIG. 23: Human CD28-Fc binding Nanobodies bind human CD28 expressing Jurkat cells.

Figure 24:
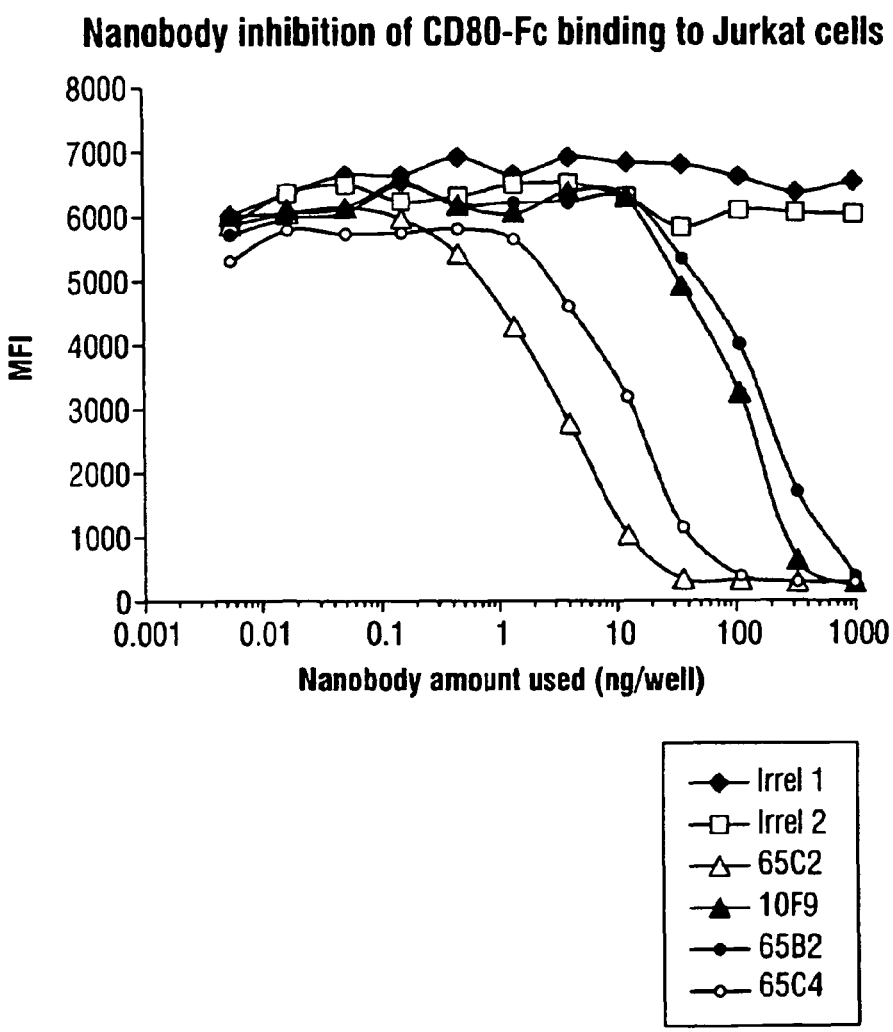

FIG. 24: Anti-CD28 Nanobodies inhibit human CD80-Fc binding to CD28 expressing Jurkat cells.

Figure 25:
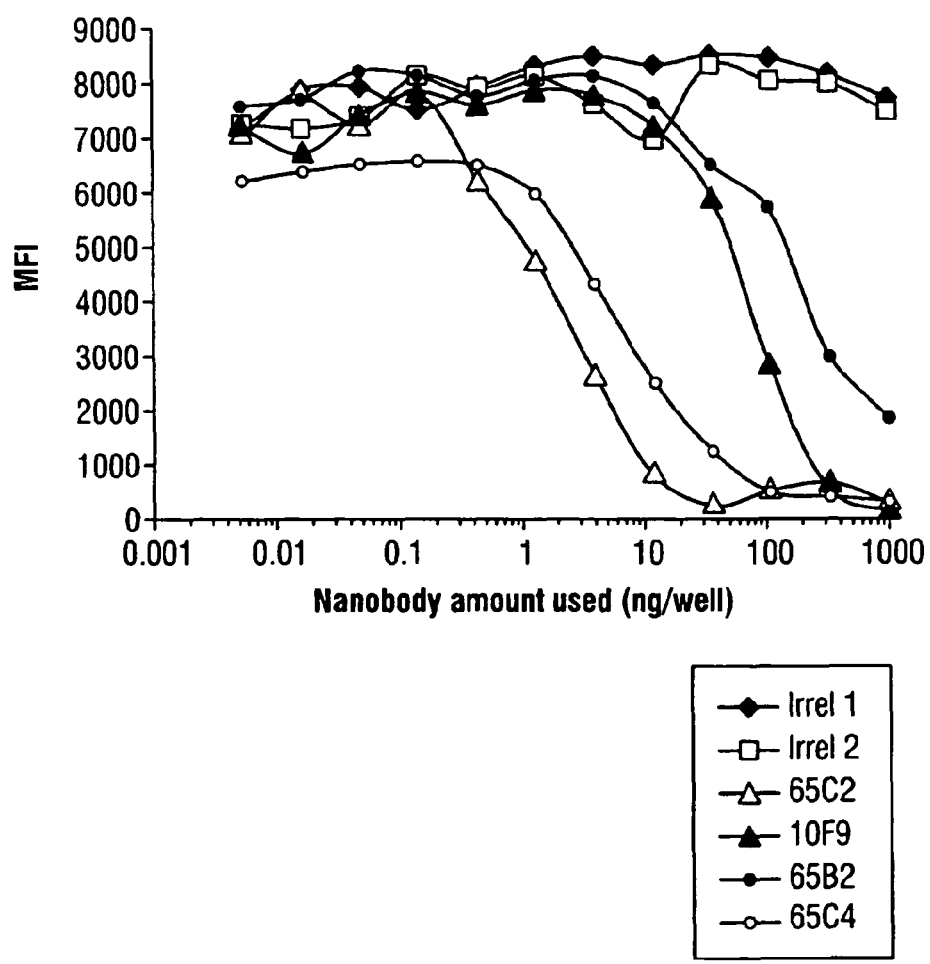

FIG. 25: Anti-CD28 Nanobodies inhibit human CD86-Fc binding to CD28 expressing Jurkat cells.

Figure 26:
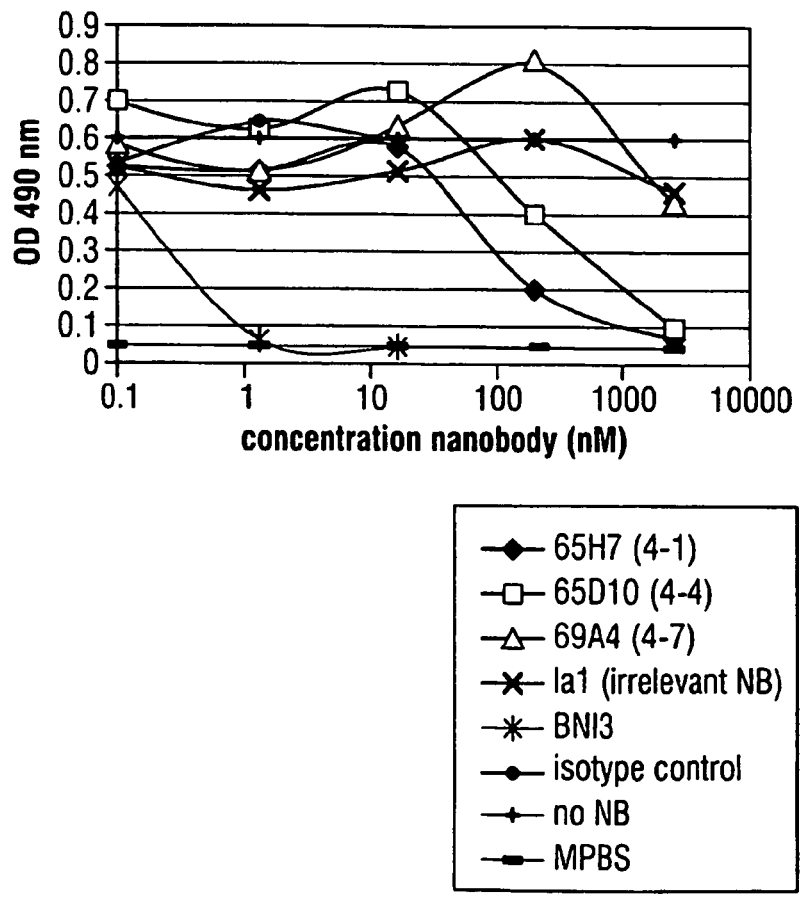
Figure 27:
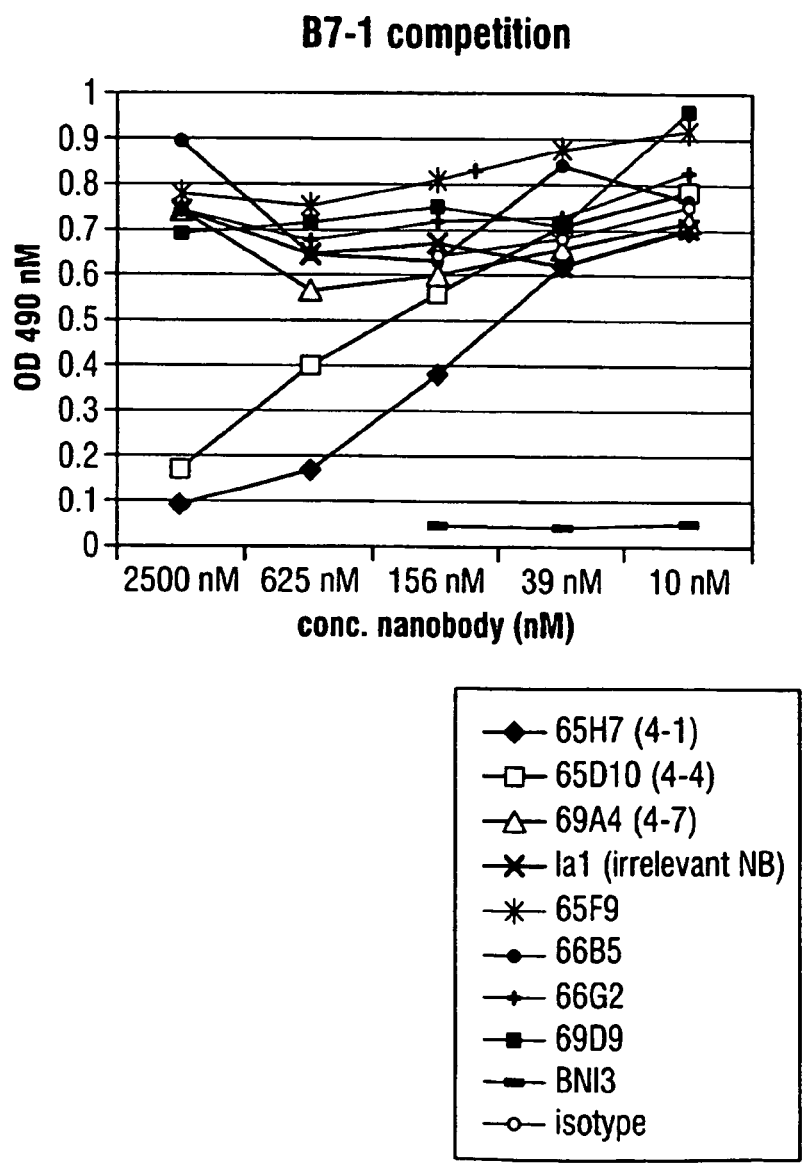

FIGS. 26 and 27: OD values obtained in competition ELISA: CTLA4 binding Nanobodies compete with B7-1 for binding to CTLA4, as described in Example 48.

Figure 28:
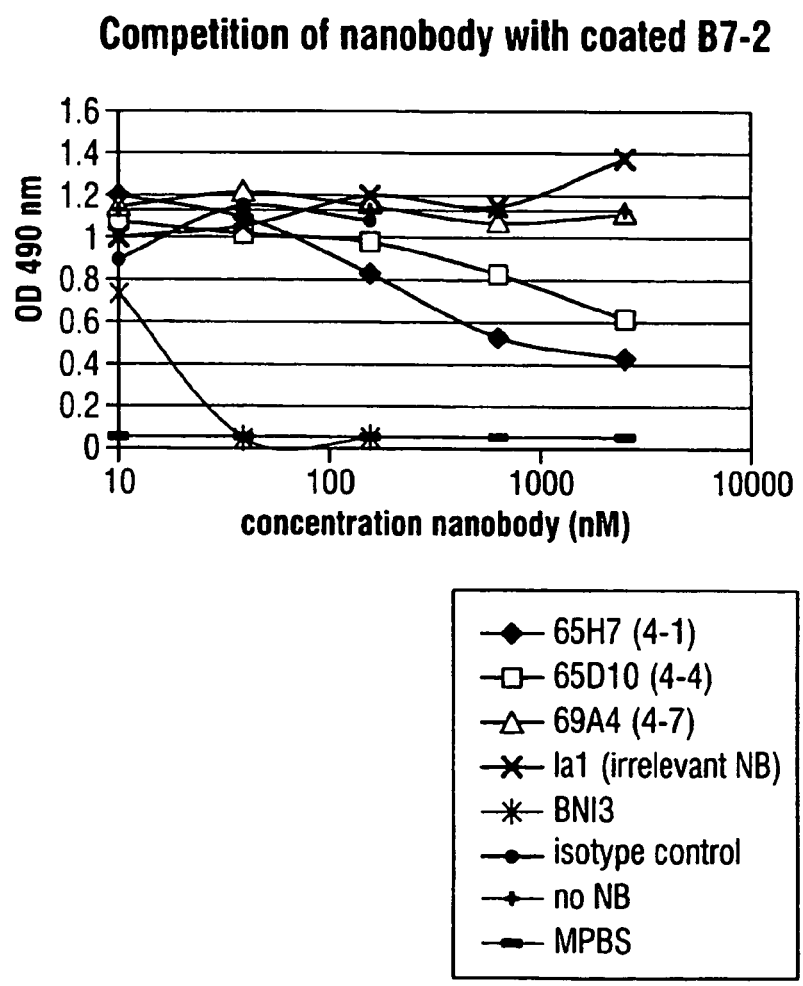
Figure 29:
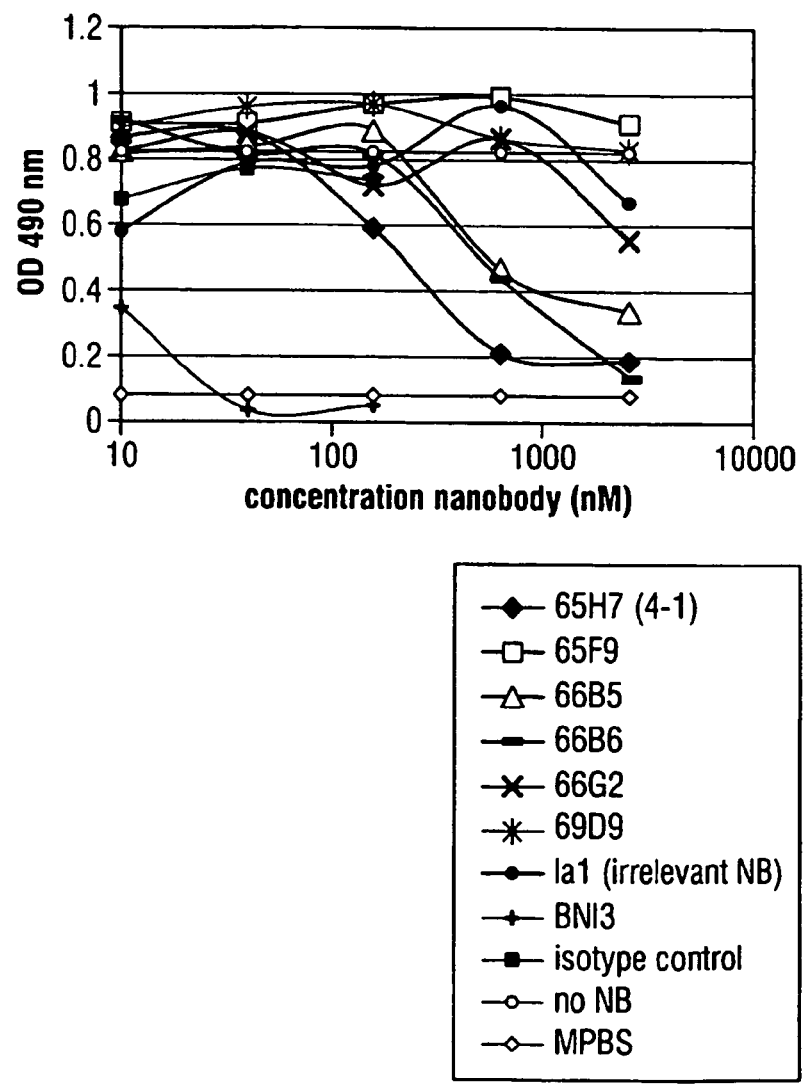

FIGS. 28 and 29: OD values obtained in competition ELISA: CTLA4 binding Nanobodies compete with B7-2 for binding to CTLA4, as described in Example 49.

Figure 30:
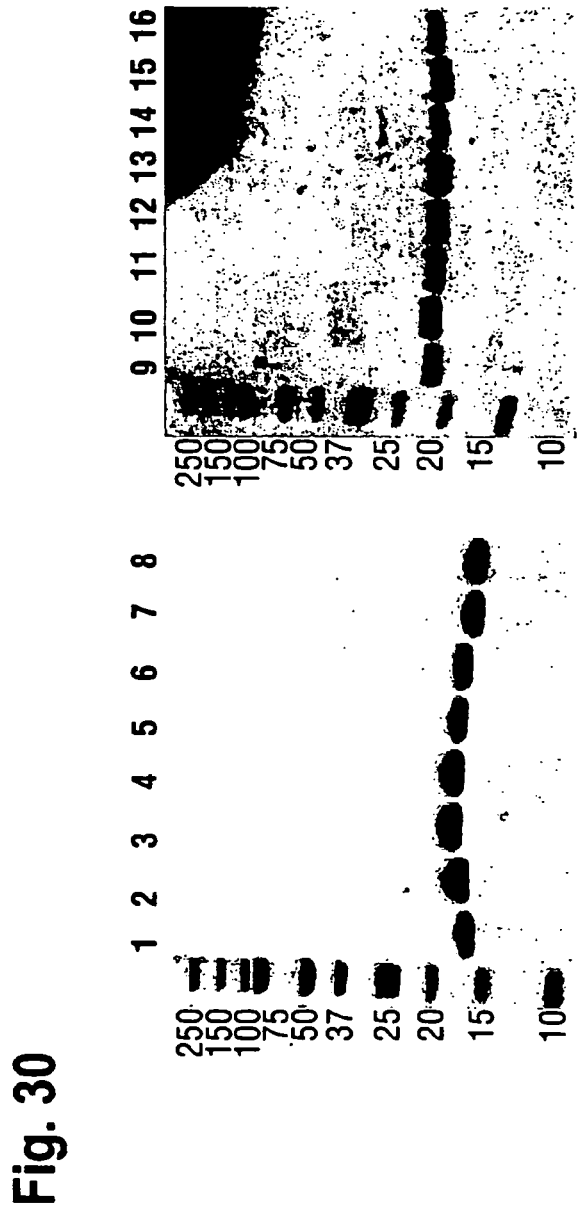

FIG. 30: Coomassie Blue stained reducing SDS-PAGE gel analysis of purified monomeric CTLA4 binding Nanobodies. Left lane: molecular weight markers (Biorad), Numbered lanes: purified Nanobodies, labeled according to Table C-10.

Figure 31:
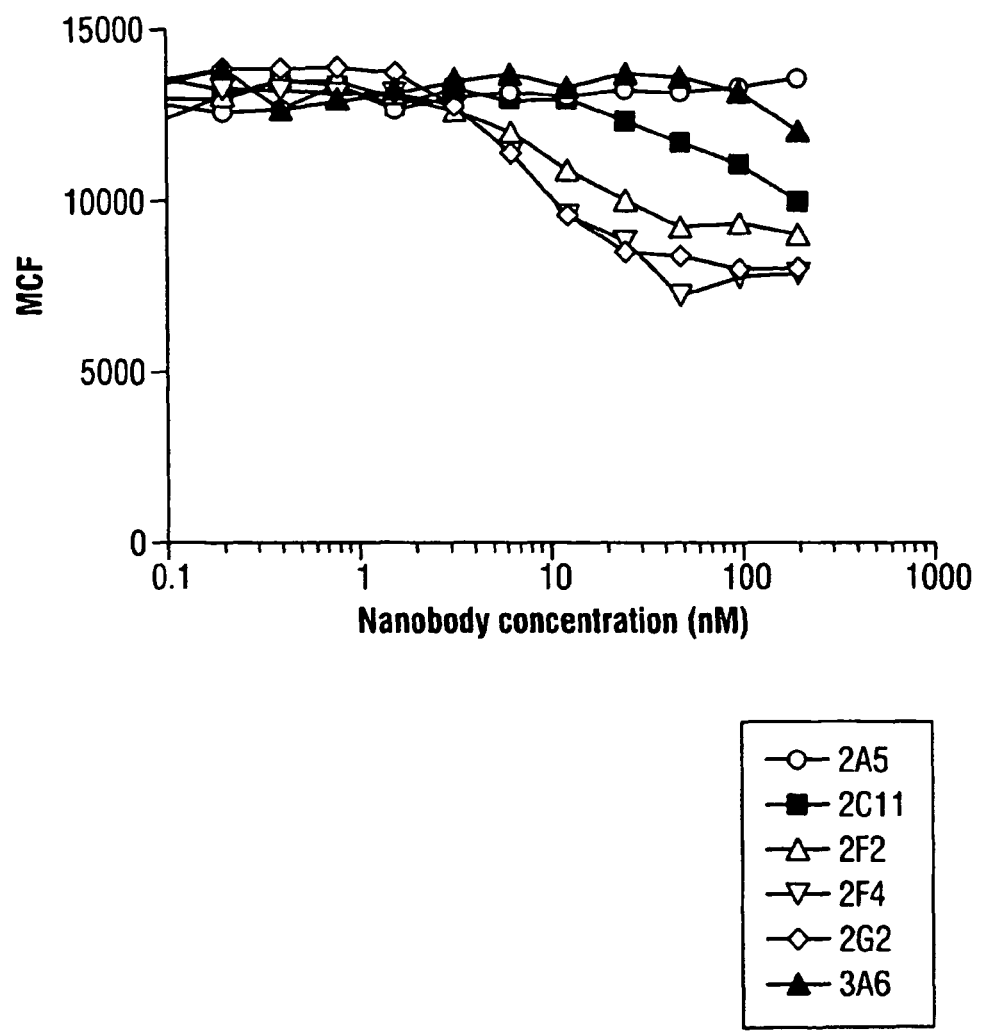
Figure 32:
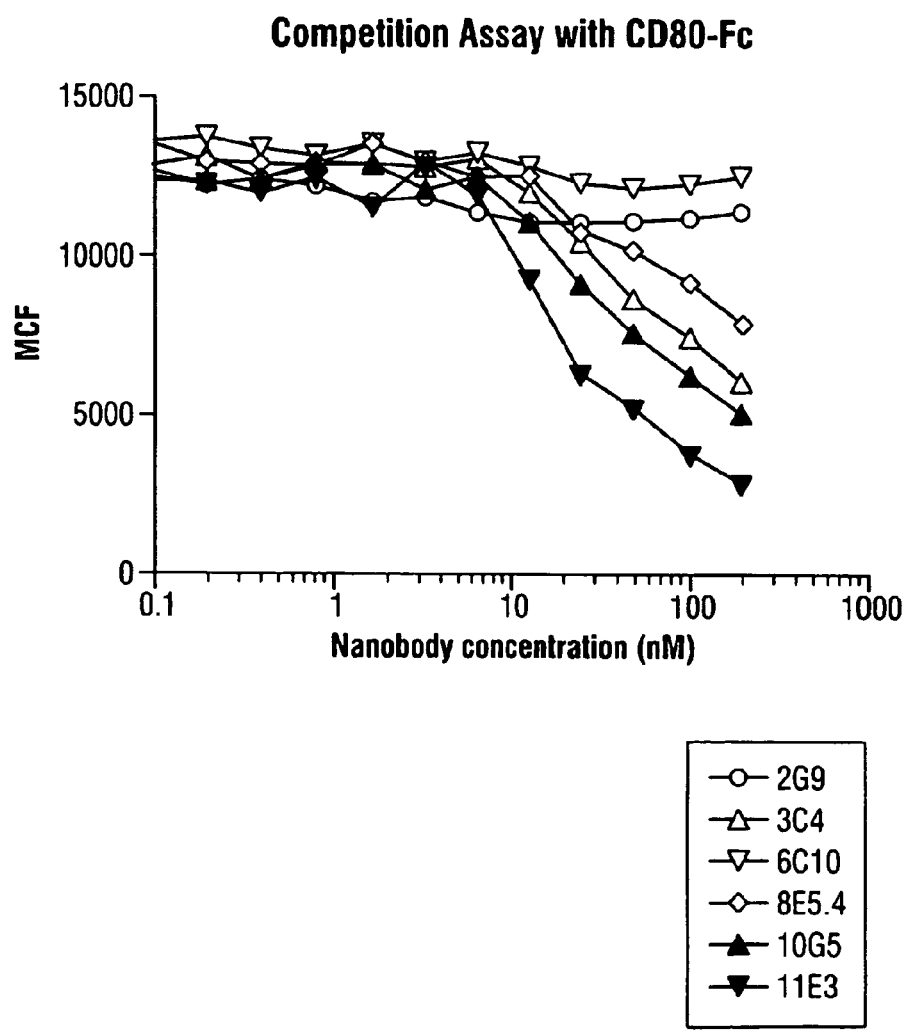
Figure 33:
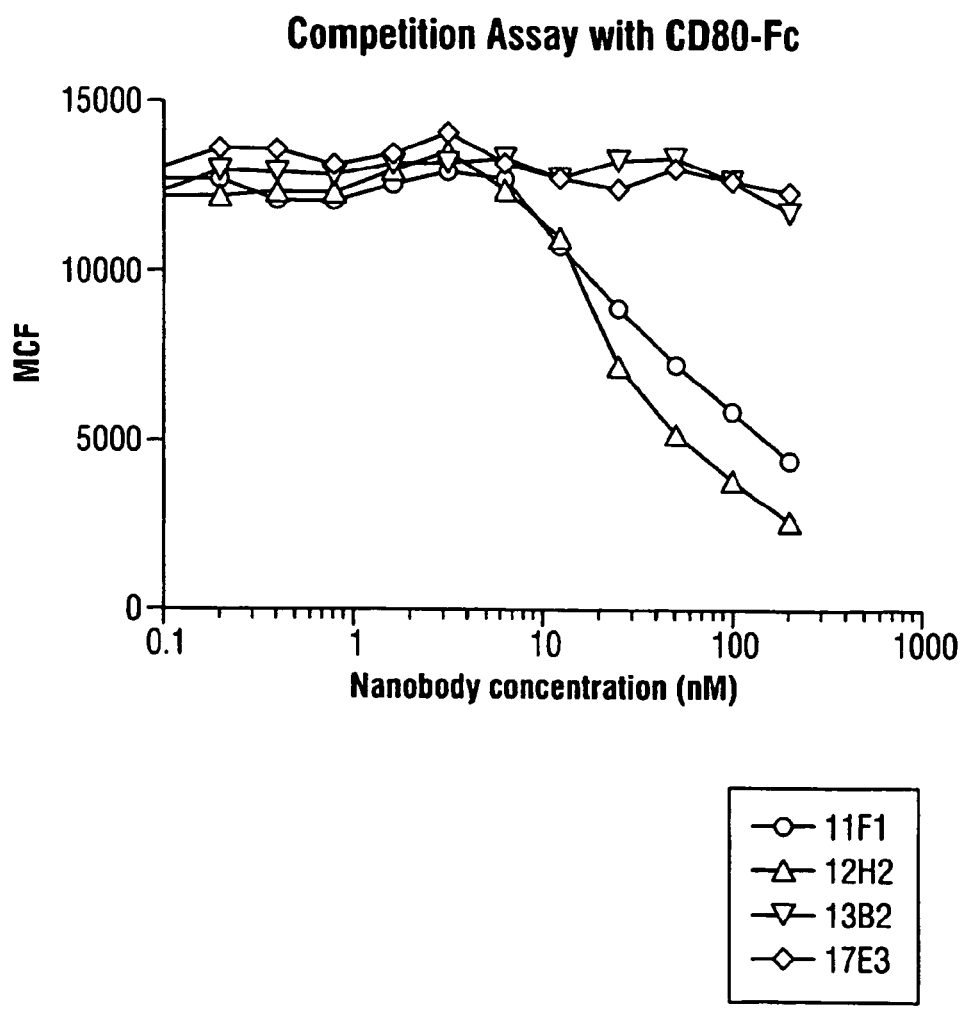

FIGS. 31, 32 and 33: CTLA4 binding Nanobodies inhibit human CD80-Fc interaction with human CTLA4 overexpressing CHO cells.

Figure 34:
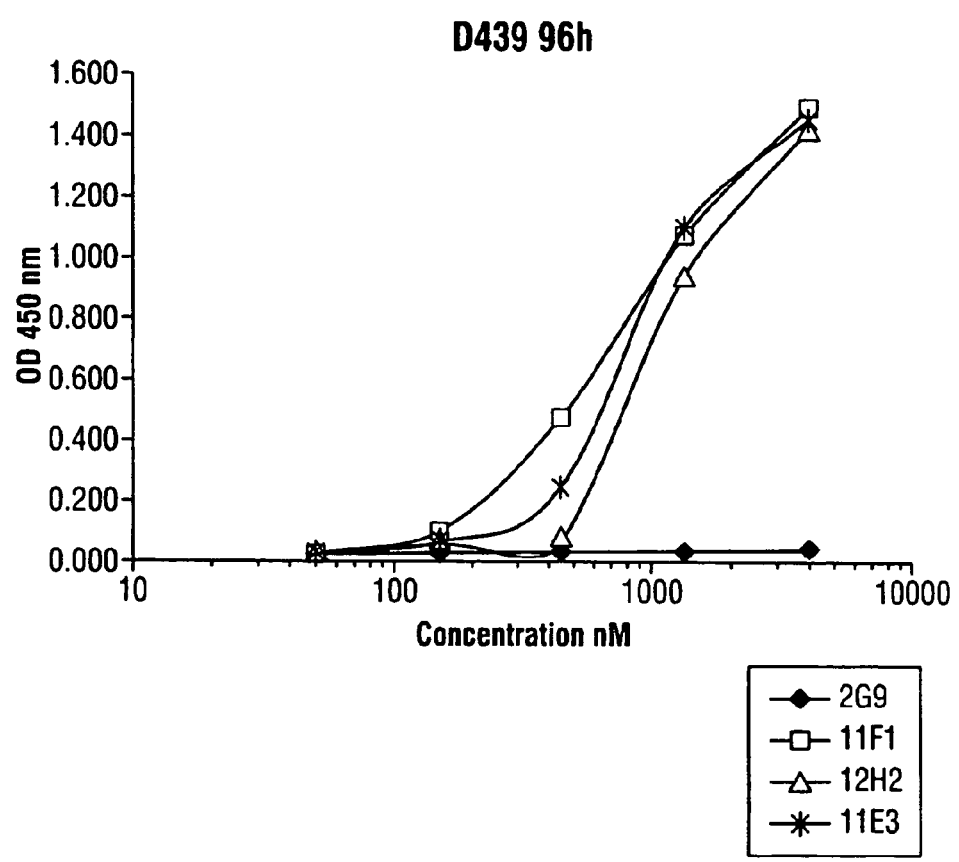

FIG. 34: IL-2 production in whole blood or PBMC in the presence of CTLA4 binding Nanobodies measured in ELISA as described in Example 57.

Figure 35:
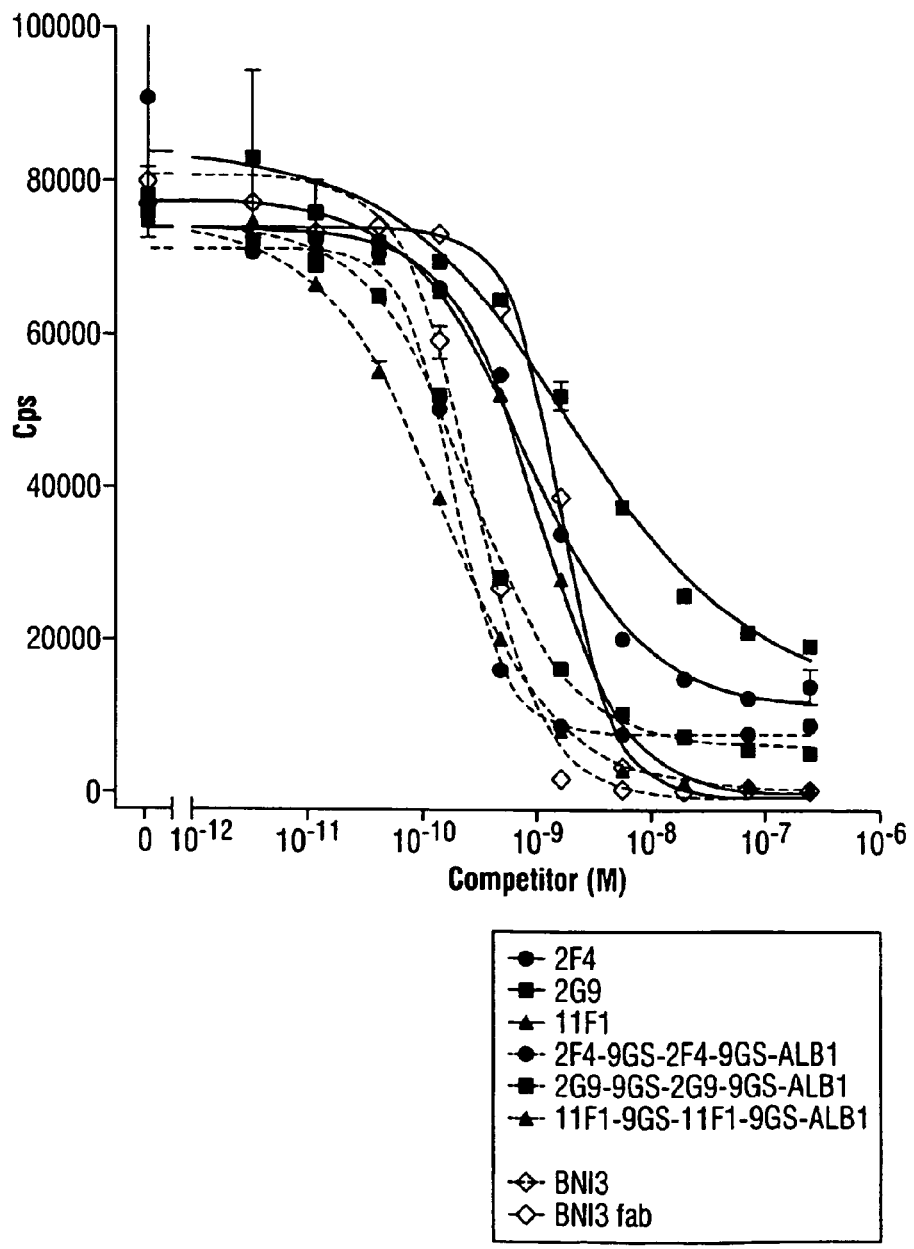

FIG. 35: Inhibition of CD80-Fc interaction with human CTLA4-Fc by monovalent and multivalent CTLA4 binding Nanobodies. Inhibition of interaction was determined in alphascreen as described in Example 59.

Figure 36:
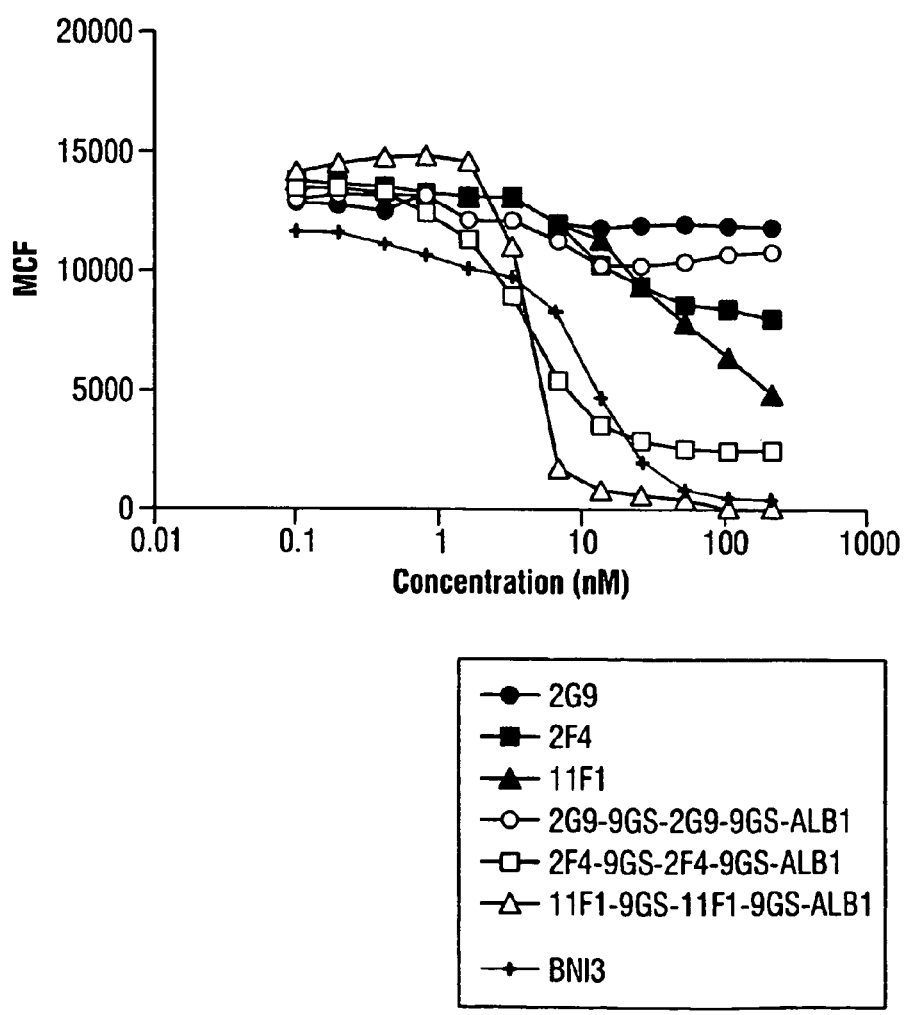

FIG. 36: Inhibition of CD80-Fc interaction with human CTLA4 overexpressing CHO cells by monovalent and multivalent CTLA4 binding Nanobodies. Inhibition of interaction was determined in FACS as described in Example 60.

Figure 37:
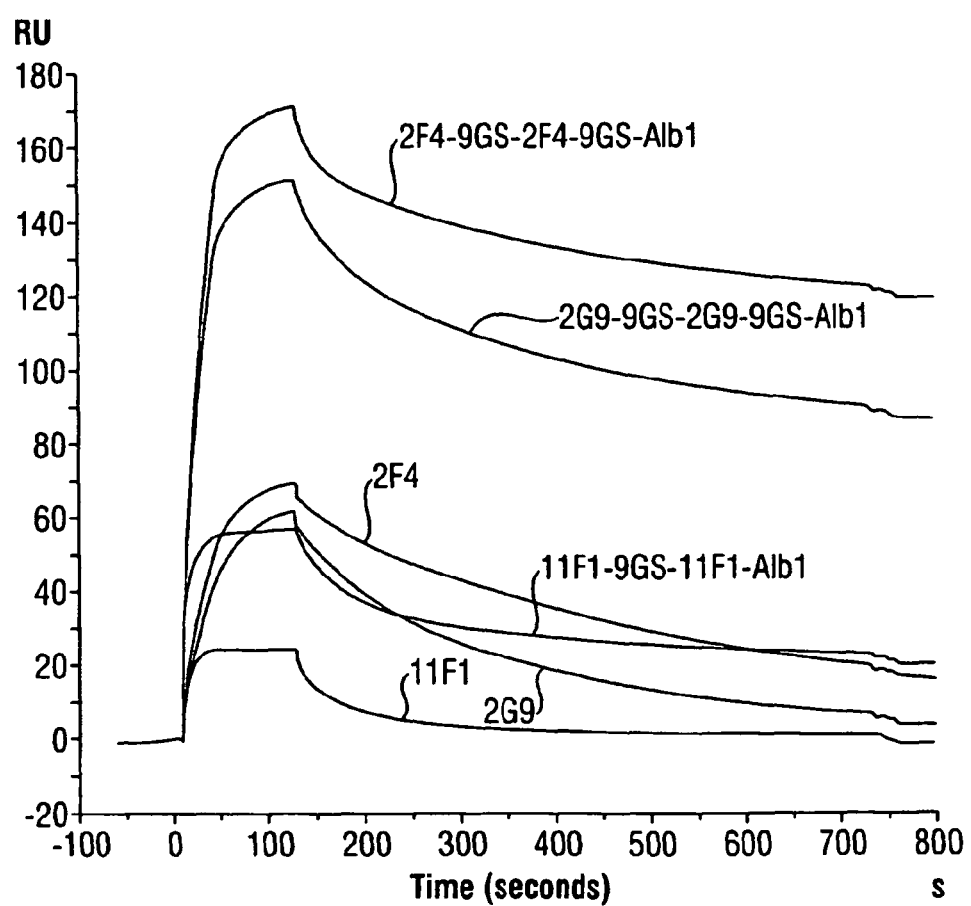

FIG. 37: Sensorgram of monovalent and multivalent CTLA4 binding Nanobodies. Binding affinity was determined as described in Example 61.

Figure 38:
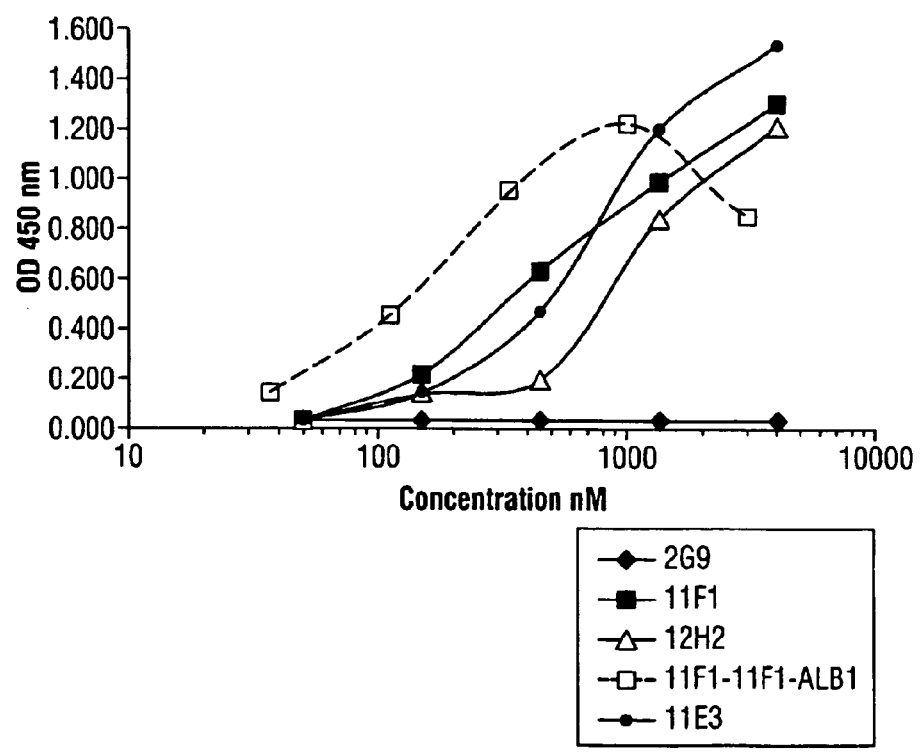

FIG. 38: IL-2 production in whole blood or PBMC in the presence of monovalent or multivalent CTLA4 binding Nanobodies measured in ELISA as described in Example 62.

FIG. 39: Alignment of the amino acid sequence of CTLA4 binding Nanobody 11F1 with human immunoglobulin germline sequences.

FIG. 40: Alignment of the amino acid sequence of CTLA4 binding Nanobody 12E3 with human immunoglobulin germline sequences.

FIG. 41: Partial humanized Nanobody 11F1.
FIG. 42: Partial humanized Nanobody 12E3.

EXAMPLE 1

Materials

A fusion protein consisting of the extracellular part of human CD80 and human Fc gamma 1 was obtained from R&D Systems (Minneapolis, Minn.) as a recombinant protein produced in NS0 cells (Cat #140-B1).

A fusion protein consisting of the extracellular part of human CD86 and human Fc gamma 1 was obtained from R&D Systems as a recombinant protein produced in NS0 cells (Cat #140-B2).

A fusion protein consisting of the extracellular (173aa) domain of human CD80 fused to murine IgG2a Fc+hinge (232 aa) was obtained from Ancell (Bayport, Minn.) as recombinant protein produced in CHO cells (Cat #: 510-820).

A biotinylated fusion protein consisting of the extracellular part of human CD80 and mouse Fc gamma 2a was obtained from Ancell (Bayport, Minn.) as a recombinant protein produced in CHO cells (Cat #510-030).

A fusion protein consisting of the extracellular part of human CD86 and mouse Fc gamma 2a was obtained from Ancell (Bayport, Minn.) as a recombinant protein produced in CHO cells (Cat #509-820).

Human IgG1, purified from a human plasma, was obtained from Sigma-Aldrich (St. Louis, Mo.) (Cat # I-5154)

Mouse IgG2a, purified from mouse myeloma UPC-10, was obtained from Sigma-Aldrich (St. Louis, Mo.) (Cat # M-9144)

Anti-Llama IgG (h&l) HRP conjugated antibody, an affinity purified polyclonal antiserum against llama IgG raised in goat and crosslinked to horseradish peroxidase was obtained from Bethyl Labs (Montgomery, Tex.).

CHO-K1 cells were obtained from ATCC (Manassas, Va.) (Cat # CCL-61) and maintained according to the provider's instructions.

Raji cells were obtained from ECACC (Porton Down, Salisbury, Wiltshire, UK) (Cat #85011429) and maintained according to the provider's instructions.

A fusion protein consisting of the extracellular part of human CD152 and human Fc gamma 1 (CTLA4-Ig) was obtained from Chimerigen (Allston, Mass.) as a recombinant protein produced in NS1 cells (Cat # HF-211A4).

A fusion protein consisting of the extracellular part of human CD152 and human Fc gamma 1 (CTLA4-Ig) was obtained from R&D Systems as a recombinant protein produced in Sf21 insect cells (Cat #325-CT/CF).

A fusion protein consisting of the extracellular part of human CD28 and human Fc gamma 1 (CD28-Ig) was obtained from R&D Systems as a recombinant protein produced in NS0 cells (Cat #342-CD).

A fusion protein consisting of the extracellular part of human PD-1 and mouse Fc gamma 1 was obtained from R&D Systems as a recombinant protein produced in NS0 cells (Cat #1086-PD).

A fusion protein consisting of the extracellular part of human PD-L2 and mouse Fc gamma 1 was obtained from R&D Systems as a recombinant protein produced in NS0 cells (Cat #1224-PL).

A fusion protein consisting of the extracellular part of human B7-H1 (PD-L1) and mouse Fc gamma 1 was obtained from R&D Systems as a recombinant protein produced in NS0 cells (Cat #156-B7).

A fusion protein consisting of the extracellular part of human B7-H2 (ICOSL) and mouse Fc gamma 1 was obtained from R&D Systems as a recombinant protein produced in NS0 cells (Cat #165-B7).

Anti-human IgG1 Fc PE conjugated F(ab')2, a polyclonal antiserum against human IgG1 Fc raised in goat, affinity purified, digested to F(ab')2 fragments and crosslinked to R-phycoerythrin was obtained from Jackson Immunoresearch Laboratories (West Grove, Pa.) (Cat #109-116-170).

Mouse-anti-human CTLA4 clone BNI3, a monoclonal antibody known to bind human CTLA4 and block CTLA4 interaction with CD80 and CD86, was obtained from Abcam (Cambridge, UK) (Cat # ab19792).

A phycoerythrin labeled version of BNI3 was obtained from BD Biosciences (San Jose, Calif.) (Cat #555853).

EXAMPLE 2

Immunizations with CD80 and/or CD86

Two llamas (No. 089 and No. 090) were immunized with 100 or 50 μg doses of R&D Systems Cat #140-B1, alternated with 20 or 10 μg doses of Ancell Cat #509-820 according to the scheme outlined in Table C-1. Both proteins were formulated in Stimune adjuvants (Cedi Diagnostics B.V., Lelystad, The Netherlands). Blood was collected from these animals as indicated in Table C-1.

EXAMPLE 3

Library Construction

Peripheral blood mononuclear cells were prepared from blood samples using Ficoll-Hypaque according to the manufacturer's instructions. Next, total RNA was extracted from these cells and used as starting material for RT-PCR to amplify Nanobody encoding gene fragments. These fragments were cloned into phagemid vector pAX50. Phage was prepared according to standard methods (see for example the prior art and applications filed by applicant cited herein) and stored after filter sterilization at 4° C. for further use. The characteristics of the constructed libraries are shown in Table C-2.

EXAMPLE 4

Selections of CD80 and/or CD86 Binding Nanobodies

Phage libraries from llama No. 089 and No. 090 were used for two rounds (R1, R2) of selections on the same plate-immobilized antigen or on alternating antigens. R&D Systems Cat #140-B1 ("HuCD80-HuIgG1") and Cat #140-B2 ("HuCD86-HuIgG1") were used as antigens and immobilized directly on Nunc Maxisorp ELISA plates at 2 μg/ml. Table C-3 summarizes the type of selection used in both rounds. Phage populations were pre-incubated with saturating amounts of Sigma-Aldrich I-5154 (human IgG1) and Sigma-Aldrich M-9144 (mouse IgG2a) both prior to the first selection as well as during the phage absorption phase in first and second selection rounds. Plate-immobilized phages were retrieved from both first and second selection rounds using trypsin elution.

Output of both R1 and R2 selections were analyzed for enrichment factor (# phage present in eluate relative to control). Based on these parameters the best selections were chosen for further analysis. To this end, the output from each selection was recloned as a pool into the expression vector pAX51. pAX51 is a derivative of pUC19. It contains the LacZ promoter which enables a controlled induction of expression using IPTG. The vector has a resistance gene for Ampicillin or Carbenicillin. The multicloning sites harbours several restriction sites of which SfiI and BstEII are frequently used for cloning Nanobodies®. In frame with the Nanobody coding sequence the vector codes for a C-terminal c-myc tag and a $(His)_6$ tag. The signal peptide is the geneIII leader sequence which translocates the expressed Nanobody to the periplasm. Individual colonies were picked and grown in 96 deep well plates (1 ml volume) and induced by adding IPTG for Nanobody expression. Periplasmic extracts (volume: ~80 µl) were prepared according to standard methods (see for example the prior art and applications filed by applicant cited herein). pAX51 cloned Nanobodies were expressed as fusion proteins containing C-terminal both the c-myc as well as the 6His tags. The sequences of the clones obtained are depicted in Table B-1.

EXAMPLE 5

Binding of the CD80 and/or CD86 Binding Nanobodies in ELISA and FACS Binding Assays Periplasmic extracts were analyzed first for their ability to bind HuCD80-HuIgG1, HuCD86-HuIgG1 or HuIgG1. To this end, 3 independent ELISA assays were set up. In these ELISAs, either HuCD80 or HuCD86 fusion proteins or human IgG1 were coated on ELISA plates which were washed and then blocked using Marvel skimmed milk powder (Premier Brands UK Ltd., Wirral, Merseyside, UK). One parallel set of ELISA plates was not coated but only blocked. Four aliquots of periplasmic extract of individual clones prepared as described in Example 4 were allowed to bind in all four types of ELISA plates. Binding of Nanobody to immobilized antigen was detected using mouse anti-c-myc tag monoclonal antibody as a secondary, followed by a goat-anti-mouse (human and bovine serum protein pre-absorbed) HRP conjugate for detection (for detailed protocol, see the prior art and prior applications filed by applicant).

Individual clones were scored as putative CD80 monoreactive or CD86 monoreactive if the clones yielded high OD's in either the ELISA plate coated with the CD80- or CD86-HuIgG1 fusion protein but not more than background in the other, nor in the plates coated with human IgG1 or uncoated but blocked plate. Clones were scored as putative CD80/CD86 bireactive if they scored high OD's on both ELISA plates but no more than background on both human IgG1 or blocked-only ELISA plates.

To verify if putative mono- or bireactive clones could bind to the native form of the antigen, periplasmic extracts of such clones were allowed to bind to Raji cells, a human B-cell lymphoma line known to express high levels of both molecules. Binding of clones was detected using anti-c-myc tag mouse monoclonal antibody, followed by a phycoerythrin conjugated F(ab')2 derived from goat-anti-mouse IgG (human and bovine crossabsorbed), and read on a BD FACS Calibur instrument. Binding was evaluated in CellQuest software. Dead cells were excluded from the analysis by gating out 7AAD vital dye positive scoring cells. Based on two separate FACS experiments, both cell binding and non-binding clones were identified in both mono- and bireactive clone selections.

Table C-4 summarizes the ELISA and FACS data for a number of representative clones, binding in both ELISA (fusion protein) and FACS (native antigen) formats. ELISA data are presented as optical density (OD), FACS data were scored as moderate increase ("+") in mean fluorescence intensity (MFI) over background fluorescence (secondary antibody only stained cells or cells stained with irrelevant specificity Nanobody plus secondary antibody), or strong increase over background ("++").

EXAMPLE 6

CD80 and/or CD86 Binding Nanobody Expression and Purification

Selected Nanobodies were expressed in *E. coli* as c-myc, His6-tagged proteins in a culture volume of 200 mL. Expression was induced by addition of 1 mM IPTG and allowed to continue for 4 h at 37° C. Cells were harvested by centrifugation and periplasmic extracts were prepared by freeze-thawing the pellets. These extracts were used as starting material for immobilized metal affinity chromatography (IMAC). Nanobodies were eluted from the column with 150 mM imidazole and subsequently subjected to gel filtration to PBS. Total yield and yield per liter of cell culture are listed in Table C-5.

SDS-PAGE of purified Nanobodies is shown in FIG. 2.

EXAMPLE 7

Inhibition of Interaction of CD80 and/or CD86 with CD28 or CTLA4

In order to determine whether mono- or bireactive Nanobodies could inhibit the interaction of CD80 and/or CD86 with CD28 or CTLA4, ELISA plates were coated with either HuCD80-MuIgG2a or HuCD86-MuIgG2a and free binding sites were blocked using 4% Marvell, as per Example 5. Next, dilution series of various confirmed mono- or bireactive clones were allowed to bind to the immobilized antigen (75 microliter volume) before a fixed amount of either HuCD28-HuIgG1 or HuCTLA4-HuIgG1 was added to the wells (25 microliter volume, 2 microgram/ml final concentration), without washing the plates in between. After incubation and a wash step, plate-bound CD80 or CD86 captured CD28- or CTLA4-HuIgG1 was revealed using a HRP conjugated human IgG1 specific secondary reagent.

Inhibition was determined based on OD values of controls having received no Nanobody (high control) or no CD28- or CTLA4-HuIgG1 fusion protein (low control). Example OD value profiles of representative inhibitory and non-inhibitory Nanobodies are shown in FIG. 3.

EXAMPLE 8

Inhibition of Interaction of CD80 and CD86 with CD28 or CTLA4

In order to determine whether Nanobodies could inhibit the interaction of native CD80 and CD86 with CD28-Ig or CTLA4-Ig, Raji cells were incubated with serial dilutions of purified protein from confirmed clones or an irrelevant Nanobody. Next, either HuCD28-HuIgG1 or HuCTLA4-HuIgG1 was added to the cells/Nanobody suspension without washing the cells in between. After a wash step, cell-bound CD28- or CTLA4-HuIg was revealed using a phycoerythrin-conjugated F(ab')2 derived from affinity purified goat-anti-human IgG1 antiserum (bovine serum protein crossabsorbed). Percentage inhibition was determined based on MFI values of controls having received an irrelevant specificity Nanobody (high control) or no CD28- or CTLA4-Ig fusion protein at all (low control).

Example FACS profiles of representative inhibitory and non-inhibitory Nanobodies are shown in FIG. 7.

Results from both ELISA and FACS based assays are summarized in Table C-6.

EXAMPLE 9

Affinity Determination of the CD80 and/or CD86 Binding Nanobodies

Affinity constants (Kd) of individual purified Nanobody clones were determined by surface plasmon resonance on a Biacore 3000 instrument. In brief, HuCD80-HuIgG1 or HuCD86-HuIgG1 were amine-coupled to a CM5 sensor chip at densities of 3000-4000 RU. Remaining reactive groups were inactivated using ethanolamine. Nanobody binding was assessed at 1 and 0.1 microM. Each sample was injected for 4 min at a flow rate of 45 µl/min to allow for binding to chip-bound antigen. Next, binding buffer without Nanobody was sent over the chip at the same flow rate to allow for dissociation of bound Nanobody. After 2 min, remaining bound analyte was removed by injecting regeneration solution (50 mM NaOH or Glycine/HCl pH 1.5). Binding curves obtained at different concentrations of Nanobody were used to calculate Kd values.

Kd values of selected Nanobody clones are shown in Table C-7.

EXAMPLE 10

Construction and Expression of Bispecific CD80 and/or CD86 Neutralizing Nanobodies Several mono- or bi-reactive Nanobodies were expressed as bispecific fusion proteins, consisting of an N-terminal anti-CD80/CD86 Nanobody, fused to a C-terminal human serum albumin binding Nanobody (ALB1) via a 9 amino acid Gly/Ser linker. These constructs were expressed in *E. coli* as c-myc, His6-tagged proteins in shaker cultures as described in Example 6 and subsequently purified from periplasmic extracts by immobilized metal affinity chromatography (IMAC) followed by size exclusion chromatography (SEC). Examples of bispecific fusion proteins are shown in Table B-2.

EXAMPLE 11

Immunizations with PD-1

Two llamas (No. 146 and No. 147) were immunized with 6 boosts (100 or 50 µg/dose at weekly intervals) of R&D Systems (Minneapolis, Minn., US) Cat #1086-PD, which is the ectodomain of human PD1 (rhPD1-Fc), formulated in Titermax Gold (Titermax USA, Norcross, Ga., US), according to standard protocols. At week 4, sera were collected to define antibody titers against PD-1 by ELISA. In short, 96-well Maxisorp plates (Nunc Wiesbaden, Germany) were coated with rhPD1-Fc. After blocking and adding diluted sera samples, the presence of anti-PD-1 Nanobodies was demonstrated by using rabbit anti-llama immunoglobulin antiserum and anti-rabbit immunoglobulin alkaline phosphatase conjugate. The titer exceeded 16000 for both animals.

EXAMPLE 12

Library Construction

Peripheral blood mononuclear cells were prepared from blood samples obtained from llama No. 146 and No. 147 using Ficoll-Hypaque according to the manufacturer's instructions. Next, total RNA extracted was extracted from these cells and used as starting material for RT-PCR to amplify Nanobody encoding gene fragments. These fragments were cloned into phagemid vector pAX50. Phage was prepared according to standard methods (see for example the prior art and applications filed by applicant cited herein) and stored after filter sterilization at 4° C. for further use.

EXAMPLE 13

Selections of PD-1 Binding Nanobodies

Phage libraries obtained from llamas No 146 and No. 147 were used for 2 rounds of phage display selection.

rhPD1-Fc (R&D Systems, Minneapolis, US, Cat #1086-PD) was coated onto Maxisorp 96-well plates (Nunc, Wiesbaden, Germany) at 0.5 and 5 µg/ml. Preincubation of the phages with total human IgG (100 µg/ml) in 2% marvel PBST was followed by incubation with the phage libraries and extensive washing. In a first round, bound phage was aspecifically eluted with trypsin (1 mg/ml in PBS) or specifically eluted with PD-L1 (50 µg/ml) and PD-L2 (50 µg/ml) or with ICOSL (100 µg/ml) as a control. In a second round, bound phage was aspecifically eluted with trypsin (1 mg/ml in PBS) or specifically eluted with PD-L1 (40 µg/ml) and PD-L2 (40 µg/ml) or with ICOSL (80 µg/ml) as a control. After the second round of selection, enrichment was observed.

The output from the selection were plated onto LB/amp/2% glu plates. Colonies were picked and grown in 96 deep well plates (1 ml volume) and induced by adding IPTG for Nanobody expression. Periplasmic extracts (volume: ~90 µl) were prepared according to standard methods (see for example the prior art and applications filed by applicant cited herein). The sequences of the clones obtained are depicted in Table B-4.

EXAMPLE 14

Binding of the Obtained Nanobodies in ELISA

In order to determine binding specificity to PD-1 by the Nanobodies obtained from the selection described in Example 13, 96 eluted clones were tested in an ELISA binding assay setup.

In short, 5 µg/ml PD-1 ectodomain (rhPD1-Fc, R&D Systems, Minneapolis, US) was immobilized on maxisorp microtiter plates (Nunc, Wiesbaden, Germany) and free binding sites were blocked using 4% Marvel in PBS. Next, 10 µl of periplasmic extract containing Nanobody of the different clones in 100 µl 2% Marvel PBST were allowed to bind to the immobilized antigen. After incubation and a wash step, Nanobody binding was revealed using a mouse-anti-myc secondary antibody, which was after a wash step detected with a HRP-conjugated donkey-anti-mouse antibody. Binding specificity was determined based on OD values compared to controls having received no Nanobody (low control). 72 out of the 96 selected clones were able to bind to PD-1 with some specificity. 3 clones were shown to bind to the Fc part of the PD1-Fc-fusion.

EXAMPLE 15

Inhibition of Interaction of PD-L1 and/or PD-L2 with PD-1

In order to determine B7-H1 (PD-L1) and PD-L2 competition efficiency of PD-1 binding Nanobodies, the positive clones from the binding assay of Example 14 were tested in an ELISA competition assay setup.

In short, 2 μg/ml PD-1 ectodomain (rhPD1-Fc, R&D Systems, Minneapolis, US) was immobilized on maxisorp microtiter plates (Nunc, Wiesbaden, Germany) and free binding sites were blocked using 4% Marvel in PBS. Next, 0.5 μg/ml of PD-L2-biotin or 0.5 μg/ml of B7-H1-biotin was preincubated with 10 μl of periplasmic extract containing Nanobody of the different clones and a control with only the biotinylated protein (high control). The biotinylated protein was allowed to bind to the immobilized receptor with or without Nanobody. After incubation and a wash step, biotinylated protein binding was revealed using a HRP-conjugated streptavidine. Binding specificity was determined based on OD values compared to controls having received no Nanobody (high control).

OD values obtained are depicted in FIG. 7. From these values clones were selected for recloning in production vector pAX51. After expression, the obtained Nanobodies were purified via the His-tag on Talon beads. Purified Nanobodies were tested in ELISA for binding to PD-1 as described in Example 14. Results are shown in FIG. 8.

EXAMPLE 16

Determining Competition Efficiency of PD-1 Binding Nanobodies by Titration of Purified Nanobody In order to determine competition efficiency of PD-1 binding Nanobodies, the positive clones of the previous binding assay were tested in an ELISA competition assay setup.

In short, 2 μg/ml PD-1 ectodomain (R&D Systems Cat #1086-PD, Minneapolis, US) was immobilized on maxisorp microtiter plates (Nunc, Wiesbaden, Germany) and free binding sites were blocked using 4% Marvel in PBS. Next, 0.5 μg/ml of biotinylated PD-L2 or B7-H1 was preincubated with a dilution series of purified Nanobody. An irrelevant Nanobody against FcgR1 (49C5) was used as a negative controle, since this Nanobody does not bind to PD-1. PD-L2 or B7-H1 without biotin (cold PD-L2 or cold B7-H1) was used as a positive controle for competition. The results are shown in FIGS. 9 and 10. 4 Nanobody families show competition with PD-L2-biotin for binding to PD-1 in a dose-dependent matter. The same 4 Nanobody families also show competition with B7-H1-biotin for binding to PD-1 in a dose-dependent manner.

EXAMPLE 17

Immunizations with B7-H1 (PD-L1)

One llama (No. 149) was immunized with 6 boosts (100 or 50 μg/dose at weekly intervals) of R&D Systems (Minneapolis, Minn., US) Cat #156-B7, which is the ectodomain of human B7-H1 (rh B7H1-Fc), formulated in Titermax Gold (Titermax USA, Norcross, Ga., US), according to standard protocols. At week 4, sera were collected to define antibody titers against B7-H1 by ELISA. In short, 96-well Maxisorp plates (Nunc Wiesbaden, Germany) were coated with rh B7H1-Fc. After blocking and adding diluted sera samples, the presence of anti-B7-H1 Nanobodies was demonstrated by using rabbit anti-llama immunoglobulin antiserum and anti-rabbit immunoglobulin alkaline phosphatase conjugate. The titer exceeded 16000.

EXAMPLE 18

Library Construction

Peripheral blood mononuclear cells were prepared from blood samples obtained from llama No. 149 using Ficoll-Hypaque according to the manufacturer's instructions. Next, total RNA extracted was extracted from these cells and used as starting material for RT-PCR to amplify Nanobody encoding gene fragments. These fragments were cloned into phagemid vector pAX50. Phage was prepared according to standard methods (see for example the prior art and applications filed by applicant cited herein) and stored after filter sterilization at 4° C. for further use.

EXAMPLE 19

Selections of B7-H1 (PD-L1) Binding Nanobodies

The phage library obtained from llamas No. 149 was used for 2 rounds of phage display selection.

In a first round, rhB7H1-Fc (R&D Systems, Minneapolis, US, Cat #156-B7) or rhPDL2-Fc (R&D Systems, Minneapolis, US, Cat #1224-PL) was coated onto Maxisorp 96-well plates (Nunc, Wiesbaden, Germany) at 0.5 and 5 μg/m. Preincubation of the phages with total human IgG (100 μg/ml) in 2% marvel PBST was followed by incubation with the phage libraries and extensive washing. Bound phage was aspecifically eluted with trypsin (1 mg/ml in PBS) or specifically eluted with PD-1 (100 μg/ml) or with BSA (100 μg/ml) as a control. Enrichment was observed over non-coated wells and wells aspecifically coated with rhPDL2-Fc.

In a second round, rhB7H1-Fc (R&D Systems, Minneapolis, US, Cat #156-B7) was coated onto Maxisorp 96-well plates (Nunc, Wiesbaden, Germany) at 0.5 and 5 μg/m. Bound phage was aspecifically eluted with trypsin (1 mg/ml in PBS) or specifically eluted with PD-1 (100 μg/ml) or with BSA (100 μg/ml) as a control. After this second round of selection, high enrichment was observed.

The output from the selection were plated onto LB/amp/ 2% glu plates. Colonies were picked and grown in 96 deep well plates (1 ml volume) and induced by adding IPTG for Nanobody expression. Periplasmic extracts (volume: ~80 μl) were prepared according to standard methods (see for example the prior art and applications filed by applicant cited herein). The sequences of the clones obtained are depicted in Table B-5.

EXAMPLE 20

Binding of the Obtained Nanobodies in ELISA

In order to determine binding specificity to B7-H1 by the Nanobodies obtained from the selection described in Example 19, 96 eluted clones were tested in an ELISA binding assay setup.

In short, 5 μg/ml B7-H1 ectodomain (rhB7H1-Fc, R&D Systems, Minneapolis, US, Cat #156-B7) or control Fc was immobilized on maxisorp microtiter plates (Nunc, Wiesbaden, Germany) and free binding sites were blocked using 4% Marvel in PBS. Next, 10 μl of periplasmic extract containing Nanobody of the different clones in 100 μl 2% Marvel PBST were allowed to bind to the immobilized antigen. After incubation and a wash step, Nanobody binding was revealed using a mouse-anti-myc secondary antibody, which was after a wash step detected with a HRP-conjugated donkey-anti-mouse antibody. Binding specificity was determined based on OD values compared to controls having received no Nanobody (low control). 17 out of the 96 selected clones were able to bind to B7-H1 with some specificity. 1 clone was shown to bind to the Fc part of the B7-H1-Fc-fusion as it also yielded high OD values in the parallel Fc control ELISA.

Based on these binding data, clones were selected for recloning in production vector pAX51. After expression, the obtained Nanobodies were purified via the His-tag on Talon beads. Purified Nanobodies were again tested for binding B7-H1 in the ELISA binding assay as described above. OD values are shown in FIG. 11.

EXAMPLE 21

Inhibition of Interaction of B7-H1 (PD-L1) with PD-1

In order to determine PD-1 competition efficiency of B7-H1 binding Nanobodies, the positive clones of the binding assay were tested in an ELISA competition assay setup.

In short, 2 μg/ml B7-H1 ectodomain (rhB7H1-Fc, R&D Systems, Minneapolis, US, Cat #156-B7) was immobilized on maxisorp microtiter plates (Nunc, Wiesbaden, Germany) and free binding sites were blocked using 4% Marvel in PBS. Next, 0.5 μg/ml of PD-1-biotin was preincubated with 10 μl of periplasmic extract containing Nanobody of the different clones and a control with only PD-1-biotin (high control). The PD-1-biotin was allowed to bind to the immobilized ligand with or without Nanobody. After incubation and a wash step, PD-1 binding was revealed using a HRP-conjugated streptavidine. Binding specificity was determined based on OD values compared to controls having received no Nanobody (high control). OD values for the different Nanobody clones are depicted in FIG. 12.

EXAMPLE 22

Determining Competition Efficiency of B7-H1 Binding Nanobodies by Titration of Purified Nanobody In order to determine competition efficiency of B7-H1 binding Nanobodies, the positive clones of the previous binding assay were tested in an ELISA competition assay setup.

In short, 2 μg/ml B7-H1 ectodomain (rhB7H1-Fc, R&D Systems, Minneapolis, US, Cat #156-B7) was immobilized on maxisorp microtiter plates (Nunc, Wiesbaden, Germany) and free binding sites were blocked using 4% Marvel in PBS. Next, 0.5 μg/ml of PD-1 was preincubated with a dilution series of purified Nanobody. An irrelevant Nanobody against FcgR1 (49C5) was used as a negative controle, since this Nanobody does not bind to B7-H1. Unlabelled PD-1 was used as a positive controle for competition of PD1-biotin. The results are shown in FIG. 13. 3 Nanobody families show competition with PD-1-biotin for binding to B7-H1 in a dose-dependent manner.

EXAMPLE 23

Immunizations with PD-L2

One llama (No. 149) was immunized with 6 boosts (100 or 50 μg/dose at weekly intervals) of R&D Systems (Minneapolis, Minn., US) Cat #1224-PL, which is the ectodomain of human PD-L2 (rhPDL2-Fc), formulated in Titermax Gold (Titermax USA, Norcross, Ga., US), according to standard protocols. At week 4, sera were collected to define antibody titers against PD-L2 by ELISA. In short, 96-well Maxisorp plates (Nunc Wiesbaden, Germany) were coated with rhPDL2-Fc. After blocking and adding diluted sera samples, the presence of anti-PD-L2 Nanobodies was demonstrated by using rabbit anti-llama immunoglobulin antiserum and anti-rabbit immunoglobulin alkaline phosphatase conjugate. The titer exceeded 16000.

EXAMPLE 24

Library Construction

Peripheral blood mononuclear cells were prepared from blood samples obtained from llama No. 149 using Ficoll-Hypaque according to the manufacturer's instructions. Next, total RNA extracted was extracted from these cells and used as starting material for RT-PCR to amplify Nanobody encoding gene fragments. These fragments were cloned into phagemid vector pAX50. Phage was prepared according to standard methods (see for example the prior art and applications filed by applicant cited herein) and stored after filter sterilization at 4° C. for further use.

EXAMPLE 25

Selection of PD-L2 Binding Nanobodies

The phage library obtained from llamas No 149 was used for 2 rounds of phage display selection.

In a first round, rhB7H1-Fc (R&D Systems, Minneapolis, US, Cat #156-B7) or rhPDL2-Fc (R&D Systems, Minneapolis, US, Cat #1224-PL) was coated onto Maxisorp 96-well plates (Nunc, Wiesbaden, Germany) at 0.5 and 5 μg/m. Pre-incubation of the phages with total human IgG (100 μg/ml) in 2% marvel PBST was followed by incubation with the phage libraries and extensive washing. Bound phage was aspecifically eluted with trypsin (1 mg/ml in PBS) or specifically eluted with PD-1 (100 μg/ml) or with BSA (100 μg/ml) as a control. Enrichment was observed over non-coated wells and control wells coated with rhPDL1-Fc.

In a second round, rhB7H2-Fc (R&D Systems, Minneapolis, US, Cat #1224-PL) was coated onto Maxisorp 96-well plates (Nunc, Wiesbaden, Germany) at 0.5 and 5 μg/m. Bound phage was aspecifically eluted with trypsin (1 mg/ml in PBS), specifically eluted with PD-1 (100 μg/ml), or with BSA (100 μg/ml) as a control. After this second round of selection, high enrichment was observed.

The output from the selection were plated onto LB/amp/2% glu plates. Colonies were picked and grown in 96 deep well plates (1 ml volume) and induced by adding IPTG for Nanobody expression. Periplasmic extracts (volume: ~80 μl) were prepared according to standard methods (see for example the prior art and applications filed by applicant cited herein). The sequences of the clones obtained are depicted in Table B-6.

EXAMPLE 26

Binding of the Obtained Nanobodies in ELISA

In order to determine binding specificity to PD-L2 by the Nanobodies obtained from the selection described in Example 25, 96 eluted clones were tested in an ELISA binding assay setup.

In short, 5 µg/ml PD-L2 ectodomain (R&D Systems, Minneapolis, US, Cat #1224-PL) was immobilized on maxisorp microtiter plates (Nunc, Wiesbaden, Germany) and free binding sites were blocked using 4% Marvel in PBS. Next, 10 µl of periplasmic extract containing Nanobody of the different clones in 100 µl 2% Marvel PBST were allowed to bind to the immobilized antigen. After incubation and a wash step, Nanobody binding was revealed using a mouse-anti-myc secondary antibody, which was after a wash step detected with a HRP-conjugated donkey-anti-mouse antibody. Binding specificity was determined based on OD values compared to controls having received no Nanobody (low control). 32 out of the 96 selected clones were able to bind to PD-L2 with some specificity.

EXAMPLE 27

Inhibition of Interaction of PD-L2 with PD-1

In order to determine PD-1 competition efficiency of PD-L2 binding Nanobodies, the positive clones from the binding assay of Example 26 were tested in an ELISA competition assay setup.

In short, 2 µg/ml PD-L2 ectodomain (R&D Systems, Minneapolis, US, Cat #1224-PL) was immobilized on maxisorp microtiter plates (Nunc, Wiesbaden, Germany) and free binding sites were blocked using 4% Marvel in PBS. Next, 0.5 µg/ml of PD1-biotin was preincubated with 10 µl of periplasmic extract containing Nanobody and a control with only PD-1-biotin (high control). The PD-1-biotin was allowed to bind to the immobilized ligand with or without Nanobody. After incubation and a wash step, PD-1 binding was revealed using a HRP-conjugated streptavidine. Binding specificity was determined based on OD values compared to controls having received no Nanobody (high control).

OD values obtained are depicted in FIG. 14. From these values clones were selected for recloning in production vector pAX51. After expression, the obtained Nanobodies were purified via the His-tag on Talon beads. Purified Nanobodies were tested in ELISA for binding to PD-L2 as described in Example 26. Results are shown in FIG. 15.

EXAMPLE 28

Determining Competition Efficiency of PD-L2 Binding Nanobodies by Titration of Purified Nanobody In order to determine competition efficiency of PD-L2 binding Nanobodies, the positive clones of the previous binding assay were tested in an ELISA competition assay setup.

In short, 2 µg/ml PD-L2 ectodomain (R&D Systems, Minneapolis, US, Cat #1224-PL) was immobilized on maxisorp microtiter plates (Nunc, Wiesbaden, Germany) and free binding sites were blocked using 4% Marvel in PBS. Next, 0.5 µg/ml of PD-1 was preincubated with a dilution series of purified Nanobody. An irrelevant Nanobody against FcgR1 (49C5) was used as a negative controle, since this Nanobody does not bind to PD-L2. PD-1 without biotin (cold PD-1) was used as a positive controle for competition of PD-1-biotin. The results are shown in FIG. 16. Four clones showed competition with PD1-biotin for binding to PD-L2 in a dose-dependent manner.

EXAMPLE 29

Immunizations with B7-H2 (ICOSL)

One llama (No. 149) was immunized with 6 boosts (100 or 50 µg/dose at weekly intervals) of R&D Systems (Minneapolis, Minn., US) Cat #165-B7, which is the ectodomain of human B7-H2 (rhB7-H2-Fc), formulated in Titermax Gold (Titermax USA, Norcross, Ga., US), according to standard protocols. At week 4, sera were collected to define antibody titers against B7-H2 by ELISA. In short, 96-well Maxisorp plates (Nunc Wiesbaden, Germany) were coated with rhB7-H2-Fc. After blocking and adding diluted sera samples, the presence of anti-B7-H2 Nanobodies was demonstrated by using rabbit anti-llama immunoglobulin antiserum and anti-rabbit immunoglobulin alkaline phosphatase conjugate. The titer exceeded 16000.

EXAMPLE 30

Library Construction

Peripheral blood mononuclear cells were prepared from blood samples obtained from llama No. 149 using Ficoll-Hypaque according to the manufacturer's instructions. Next, total RNA extracted was extracted from these cells and used as starting material for RT-PCR to amplify Nanobody encoding gene fragments. These fragments were cloned into phagemid vector pAX50. Phage was prepared according to standard methods (see for example the prior art and applications filed by applicant cited herein) and stored after filter sterilization at 4° C. for further use.

EXAMPLE 31

Selections of B7-H2 Binding Nanobodies

The phage library obtained from llamas No 149 was used for 2 rounds of phage display selection.

rhB7-H2-Fc (R&D Systems, Minneapolis, US, Cat #165-B7) was coated onto Maxisorp 96-well plates (Nunc, Wiesbaden, Germany) at 0.5 and 5 µg/m. Preincubation of the phages with total human IgG (100 µg/ml) in 2% marvel PBST was followed by incubation with the phage libraries and extensive washing. In the first and second round bound phage was aspecifically eluted with trypsin (1 mg/ml in PBS) or specifically eluted with ICOS (100 µg/ml) or with PD-1 (100 µg/ml) as a control. Enrichment was observed over non-coated wells.

The output from the selection were plated onto LB/amp/ 2% glu plates. Colonies were picked and grown in 96 deep well plates (1 ml volume) and induced by adding IPTG for Nanobody expression. Periplasmic extracts (volume: ~80 µl) were prepared according to standard methods (see for example the prior art and applications filed by applicant cited herein). The sequences of the clones obtained are depicted in Table B-7.

EXAMPLE 32

Binding of the Obtained Nanobodies in ELISA

In order to determine binding specificity to B7-H2 by the Nanobodies obtained from the selection described in Example 31, 96 eluted clones were tested in an ELISA binding assay setup.

In short, 5 µg/ml B7-H2 ectodomain (R&D Systems, Minneapolis, US, Cat #165-B7) was immobilized on maxisorp microtiter plates (Nunc, Wiesbaden, Germany) and free binding sites were blocked using 4% Marvel in PBS. Next, 10 µl of periplasmic extract containing Nanobody of the different clones in 100 ul 2% Marvel PBST were allowed to bind to the immobilized antigen. After incubation and a wash step, Nanobody binding was revealed using a mouse-anti-myc secondary antibody, which was after a wash step detected with a HRP-conjugated donkey-anti-mouse antibody. Binding specificity was determined based on OD values compared to controls having received no Nanobody (low control). 75 out of the 96 selected clones were able to bind to B7-H2 with some specificity.

EXAMPLE 33

Inhibition of Interaction of B7-H2 (ICOSL) with ICOS

In order to determine ICOS competition efficiency of B7-H2 binding Nanobodies, the positive clones from the binding assay of Example 32 were tested in an ELISA competition assay setup.

In short, 1 µg/ml B7-H2 ectodomain (R&D Systems, Minneapolis, US, Cat #165-B7) was immobilized on maxisorp microtiter plates (Nunc, Wiesbaden, Germany) and free binding sites were blocked using 4% Marvel in PBS. Next, 0.25 µg/ml of ICOS-biotin was preincubated with 10 ul of periplasmic extract containing Nanobody of the different clones and a control with only ICOS-biotin (high control). The ICOS-biotin was allowed to bind to the immobilized receptor with or without Nanobody. After incubation and a wash step, ICOS binding was revealed using a HRP-conjugated streptavidine. Binding specificity was determined based on OD values compared to controls having received no Nanobody (high control).

OD values obtained are depicted in FIG. 17. Based on these values, clones were selected for recloning in production vector pAX51. After expression, the Nanobodies were purified via the His-tag on Talon beads. Purified Nanobodies were tested in ELISA for binding to B7-H2 as described in Example 32. Results are shown in FIG. 18.

EXAMPLE 34

Determining Competition Efficiency of B7-H2 Binding Nanobodies by Titration of Purified Nanobody In order to determine ICOS competition efficiency of B7-H2 binding Nanobodies, the positive clones of the binding assay were tested in an ELISA competition assay setup. In short, 1 µg/ml B7-H2 ectodomain (R&D Systems, Minneapolis, US, Cat #165-B7) was immobilized on maxisorp microtiter plates (Nunc, Wiesbaden, Germany) and free binding sites were blocked using 4% Marvel in PBS. Next, 0.25 µg/ml of ICOS-biotin was preincubated with a dilution series of purified Nanobody. An irrelevant Nanobody against FcgR1 (49C5) was used as a negative controle, since this Nanobody does not bind to B7-H2. ICOS without biotin (cold ICOS) was used as a positive controle for competition of ICOS-biotin. The results are shown in FIG. 19. 5 Nanobody families show competition with ICOS-biotin for binding to B7-H2 in a dose-dependent manner.

EXAMPLE 35

Immunizations with CD28

Two llamas (No. 45 and No. 46) were immunized with 6 boosts (100 or 50 µg/dose at weekly intervals) of CD28-Fc fusion (R&D Systems, Minneapolis, Minn., US), formulated in adjuvant Stimune (Cedi Diagnostics, the Netherlands), according to standard protocols. At week 4, sera were collected to define antibody titers against CD28 by ELISA. In short, 96-well Maxisorp plates (Nunc Wiesbaden, Germany) were coated with hCD28-Fc. After blocking and adding diluted sera samples, the presence of anti-CD28 Nanobodies was demonstrated by using rabbit anti-llama immunoglobulin antiserum and anti-rabbit immunoglobulin alkaline phosphatase conjugate. The titer exceeded 16000 for both animals.

EXAMPLE 36

Library Construction

Peripheral blood mononuclear cells were prepared from blood samples obtained from llama No. 45 and No. 46 using Ficoll-Hypaque according to the manufacturer's instructions. Next, total RNA extracted was extracted from these cells and used as starting material for RT-PCR to amplify Nanobody encoding gene fragments. These fragments were cloned into phagemid vector pAX50. Phage was prepared according to standard methods (see for example the prior art and applications filed by applicant cited herein) and stored after filter sterilization at 4° C. for further use.

EXAMPLE 37

Selections of CD28 Binding Nanobodies

Phage libraries obtained from llamas No 45 and No. 46 were used for phage display selection.

hCD28-Fc (R&D Systems, Minneapolis, US, Cat #342-CD) was coated onto Maxisorp 96-well plates (Nunc, Wiesbaden, Germany) at 0.5 and 5 µg/ml. The phages were incubated with human IgG (100 µg/ml) in 2% marvel PBST prior to incubation with the immobilized CD28. After extensive washing, plate bound phage was aspecifically eluted with trypsin (1 mg/ml in PBS) or specifically eluted with B7-1 and B7-2 (50 µg/ml). Enrichment above background was observed for all conditions.

The output from the selection were plated onto LB/amp/2% glu plates. Colonies were picked and grown in 96 deep well plates (1 ml volume) and induced by adding IPTG for Nanobody expression. Periplasmic extracts (volume: ~90 µl) were prepared according to standard methods (see for example the prior art and applications filed by applicant cited herein). The sequences of the clones obtained are depicted in Table B-8.

EXAMPLE 38

Binding of the Obtained Nanobodies in ELISA

In order to determine whether the Nanobodies obtained from the selection described in Example 37 bind CD28, 96 eluted clones were tested in an ELISA binding assay setup.

In short, 1 µg/ml CD28 (hCD28-Fc, R&D Systems, Minneapolis, US, Cat #342-CD) was immobilized on maxisorp microtiter plates (Nunc, Wiesbaden, Germany) and free binding sites were blocked using 4% Marvel in PBS. Next, 10 µl of periplasmic extract containing Nanobody of the different clones in 100 µl 2% Marvel PBST were allowed to bind to the immobilized antigen. After incubation and a wash step, Nanobody binding was revealed using a mouse-anti-myc secondary antibody, followed by a wash step and an additional incubation with a HRP-conjugated donkey-anti-mouse antibody. Binding specificity was determined based on OD values compared to controls having received no Nanobody (low control). 57 out of 96 selected clones were able to bind to CD28 with some specificity.

EXAMPLE 39

Inhibition of Interaction of B7-1 with CD28

In order to determine B7-1 competition efficiency of the CD28 binding Nanobodies, a selection of the CD28 binding clones was made and tested for B7-1 competition in an ELISA competition assay setup.

In short, 1 µg/ml B7-1-muFc (Ancell, Bayport, Minn., US, Cat #510-820) was immobilized on maxisorp microtiter plates (Nunc, Wiesbaden, Germany) and free binding sites were blocked using 4% Marvel in PBS. In another plate, 90 µl 2.2 µg/ml CD28-hFc was mixed with 10 µl periplasmic extract of the CD28 binding clones. This mixture was applied on the coated B7-1 and CD28 was allowed to bind to the immobilized B7-1. After incubation and a wash step the CD28-hFc was detected with a HRP-conjugated anti-human Fc (Jackson Immunoresearch Laboratories, West Grove, Pa., US, Cat #109-116-170). Degree of binding inhibition was determined based on OD values compared to controls having received no Nanobody (high control) of no CD28-hFc (low control).

OD values obtained are depicted in FIG. 20. From these values, clones were selected for recloning in production vector pAX51. After expression, the obtained Nanobodies were purified via the His-tag on Talon beads. Purified Nanobodies were tested in ELISA for binding to CD28 as described in Example 38. Results are shown in FIG. 21.

EXAMPLE 40

Determining Competition Efficiency of CD28 Binding Nanobodies by Titration of Purified Nanobody In order to determine B7-1 competition efficiency of CD28 binding Nanobodies, the purified Nanobodies that showed binding in the previous binding assay were tested in an ELISA competition assay setup.

In short, 1 µg/ml B7-1-muFc (Ancell, Bayport, Minn., US, Cat #510-820) was immobilized on maxisorp microtiter plates (Nunc, Wiesbaden, Germany) and free binding sites were blocked using 4% Marvel in PBS. Next, 2 µg/ml CD28-hFc was mixed with a dilution series of purified Nanobody. An irrelevant Nanobody against FcgR1 (49E4) was used as a negative controle, since this Nanobody does not bind to CD28. After incubation and a wash step the CD28-hFc was detected with a HRP-conjugated anti-human Fc (Jackson Immunoresearch Laboratories, West Grove, Pa., US, Cat #109-116-170) 1:1500 in 2% MPBST. The results are shown in FIG. 22. All Nanobodies selected showed competition with B7-1 for binding to CD28 in a dose-dependent manner.

EXAMPLE 41

Binding of CD28-Fc Binding Nanobodies to Human CD28 Expressing Jurkat Cells in FACS To verify if the CD28-Fc binding clones could also bind to the native form of the CD28 antigen, serial dilutions of purified protein preparations of such clones were allowed to bind to the human Jurkat T-cell line, which expresses human CD28. Binding of putative CD28 reactive Nanobodies clones was detected using unlabeled anti-c-myc tag mouse monoclonal antibody 9E10, followed by a phycoerythrin conjugated F(ab')2 derived from goat-anti-mouse IgG (human and bovine crossabsorbed), and read on a BD FACSarray instrument. Dead cells were excluded from the analysis by gating out TOPRO3 vital dye positive scoring cells. Binding of the Nanobodies to cells was evaluated in BD FACSarray control software as PE channel histograms. Based on these FACS experiments, all CD28-Fc binding Nanobody clones bound cell expressed CD28. Results of a representative experiment are depicted in FIG. 23.

EXAMPLE 42

Inhibition by CD28 Binding Nanobodies of the Interaction of CD28 with CD80-Fc or CD86-Fc Analysed in FACS The potency of cell-expressed CD28 binding Nanobodies to inhibit the interaction of CD28 with either CD80 or CD86 was also ranked using FACS based screening method. In brief, serial dilutions of purified Nanobodies were prepared and incubated at 4° C. with Jurkat cells. To this suspension, either HuCD80-Hu IgG1 Fc fusion protein or HuCD86-Hu IgG1 Fc fusion protein was added 30 minutes after Nanobody incubation had started. After an additional 30 minutes incubation, cells were washed and cell-bound HuCD80-Fc or HuCD86-Fc was detected using a phycoerythrin labeled $F(ab')_2$ fragment of goat anti human IgG Fc (Jackson Immunoresearch Laboratories, West Grove, Pa., US, Cat #109-116-170). Dead cells were stained by including TOPRO3 vital dye in the final resuspension buffer. All samples were read on a BD FACSarray instrument. Dead cells were excluded from the analysis by gating out TOPRO3 vital dye positive scoring cells. Inhibition of CD80-Fc or CD86-Fc binding to cell-displayed CD28 by these Nanobodies was evaluated in BD FACSarray control software as PE channel histograms.

Results were summarized as mean fluorescence values of these histograms as a function of Nanobody concentration. Results are depicted in FIG. 24.

EXAMPLE 43

Immunizations with CTLA4-Ig

Two llamas (No. 119 and No. 120) were immunized with 100 or 50 µg doses of Chimerigen Cat # HF-210A4, according to the scheme outlined in Table C-8. Both proteins were formulated in Stimune adjuvants (Cedi Diagnostics B.V., Lelystad, The Netherlands). Blood was collected from these animals as indicated in Table C-8.

EXAMPLE 44

Serum Titers of CTLA4-Ig Immunized Animals

Sera from blood samples of llamas 119 and 120 were obtained prior to immunization, during the immunization protocol and after completion of the immunizations. Chimerigen CTLA4-Ig or an irrelevant specificity human IgG1 isotype monoclonal antibody were coated onto Nunc Maxisorb plates at 2 µg/ml, blocked with 1% casein in PBS and incubated with serial dilutions of pre- and postimmune llama sera. Plate-immobilized llama IgG was detected using HRP conjugated goat-anti-llama IgG (Bethyl Labs, Montgomery, Tex.) and TMB chromogen according to standard methods.

Comparison of optical density values clearly indicated immunization induced a humoral immune response against CTLA4-Ig in both animals, and that the response was higher against CTLA4-Ig than the control protein having the same human IgG1 Fc.

EXAMPLE 45

Library Construction

Peripheral blood mononuclear cells were prepared from blood samples obtained from llama No. 119 and No. 120 using Ficoll-Hypaque according to the manufacturer's instructions. Next, total RNA was extracted from these cells and used as starting material for RT-PCR to amplify Nanobody encoding gene fragments. These fragments were cloned into phagemid vector pAX50. Phage was prepared according to standard methods (see for example the prior art and applications filed by applicant cited herein) and stored after filter sterilization at 4° C. for further use. The characteristics of the constructed libraries are shown in Table C-9.

EXAMPLE 46

Selections of CTLA4 Binding Nanobodies

Phage libraries from llama No. 119 and No. 120 were used for two rounds (R1, R2) of selections on the same plate-immobilized antigen or on soluble antigen. Chimerigen Cat # HF-210A4 CTLA4-Ig was immobilized at concentrations varying from 5 µg/ml to 0.05 µg/ml on Nunc Maxisorp ELISA plates precoated at 10 µg/ml with anti-human IgG1 Fc Nanobody. Plate-immobilized phages were retrieved using trypsin or BNI3 elution and rescued in E. coli. Rescued phages were incubated with concentrations of biotinylated CTLA4-Ig varying from 60 nM to 1 pM (Chimerigen Cat # HF-210A4, biotinylated at Ablynx according to standard procedures), captured on neutravidin precoated Maxisorb plates and eluted using trypsin or BNI3. Phage populations were pre-incubated with saturating amounts of Sigma-Aldrich #I 4506 human IgG prior to both selection rounds.

Output of both R1 and R2 selections were analyzed for enrichment factor (# phage present in eluate relative to control). Based on these parameters, the best selections were chosen for further analysis. Individual colonies were picked and grown in 96 deep well plates (1 ml volume) and induced by adding IPTG for Nanobody expression. Periplasmic extracts (volume: ~80 µl) were prepared according to standard methods (see for example the prior art and applications filed by applicant cited herein). Nanobodies were expressed as fusion proteins containing C-terminal both the c-myc as well as the 6His tags.

The sequences of the clones obtained are depicted in Table B-9.

EXAMPLE 47

Selective Binding of the Nanobodies to CTLA4Fc in ELISA

Periplasmic extracts as prepared in example 46 were analyzed first for their ability to bind HuCTLA4-HuIgG1 or HuCD28-HuIgG1. To this end, 2 independent ELISA assays were set up. In these ELISAs, either HuCTLA4 (Chimerigen) or HuCD28 (R&D Systems) fusion proteins were coated on ELISA plates which were washed and then blocked using 4% Marvel skimmed milk powder (Premier Brands UK Ltd., Wirral, Merseyside, UK) in PBS. 10 µl aliquots of periplasmic extract of individual clones prepared as described in Example 46 were allowed to bind in both ELISAs. Binding of Nanobody to immobilized antigen was detected using mouse anti-c-myc tag monoclonal antibody as a secondary antibody, followed by a goat-anti-mouse (human and bovine serum protein pre-absorbed) HRP conjugate for detection (for detailed protocol, see the prior art and prior applications filed by applicant).

Individual clones were scored as putative CTLA4 monoreactive if the clones yielded high OD's in the ELISA plate coated with the HuCTLA4-HuIgG1 fusion protein but not more than background in the other. The clones were scored CD28 and/or human IgG1 Fc crossreactive if they yielded high OD's in the ELISA plate coated with the HuCTLA4-HuIgG1 fusion protein as well as in the other. Clones binding both CD28-Fc and CTLA4-Fc were very rare.

From the 192 clones tested, 115 were able to bind to CTLA4-Fc with some specificity. Clones were selected for recloning in production vector pAX51. After expression, the obtained Nanobodies were purified via the His-tag on Talon beads.

EXAMPLE 48

Inhibition of the Interaction of CTLA4 with B7-1

In order to determine B7-1 competition efficiency of CTLA4 binding Nanobodies, the purified clones were tested in an ELISA competition assay setup.

In short, 2 µg/ml B7-1-muFc (Ancell, Bayport, Minn., US, Cat #510-820) was immobilized on maxisorp microtiter plates (Nunc, Wiesbaden, Germany) and free binding sites were blocked using 4% Marvel in PBS. Next, 0.33 nM CTLA4-hFc was mixed with a dilution series of purified Nanobody. An irrelevant Nanobody (1A1) was used as a negative controle, since this Nanobody does not bind to CTLA4. As a positive controle for competition with B7-1, the commercial CTLA-4 binding antibody (BNI-3; competing for B7-1 and B7-2) was used. After incubation and a wash step, the CTLA4-hFc was detected with a HRP-conjugated anti-human Fc (Jackson Immunoresearch Laboratories, West Grove, Pa., US, Cat #109-116-170) 1:1500 in 2% MPBST. OD values obtained, depicted in FIGS. 26 and 27, show that 2 Nanobodies selected show competition with B7-1 for binding to CTLA4 in a dose-dependent manner.

EXAMPLE 49

Inhibition of the Interaction of CTLA4 with B7-2

In order to determine B7-2 competition efficiency of CTLA4 binding Nanobodies, the purified clones were tested in an ELISA competition assay setup.

In short, 5 µg/ml B7-muFc (Ancell, Bayport, Minn., Cat #509-820) was immobilized on maxisorp microtiter plates (Nunc, Wiesbaden, Germany) and free binding sites were blocked using 4% Marvel in PBS. Next, 22 nM CTLA4-hFc was mixed with a dilution series of purified Nanobody. An irrelevant Nanobody (1A1) was used as a negative controle, since this Nanobody does not bind to CTLA4. As a positive controle for competition, the commercial CTLA-4 binding antibody (BNI-3; competing for B7-1 and B7-2) was used. After incubation and a wash step the CTLA4-hFc was detected with a HRP-conjugated anti-human Fc (Jackson Immunoresearch Laboratories, West Grove, Pa., US, Cat #109-116-170) 1:1500 in 2% MPBST. OD values obtained, depicted in FIGS. 28 and 29, show that 4 Nanobodies selected show competition with B7-2 for binding to CTLA4 in a dose-dependent manner.

EXAMPLE 50

Inhibition of the CTLA4-Fc/CD80-Fc Interaction in Alphascreen

Periplasmic extracts as prepared in example 46 were analyzed for their ability to block the interaction of HuCTLA4-HuIgG1 (Chimerigen) with HuCD80-MuIgG2a (Ancell). To this end, an alphascreen assay (Perkin Elmer, Waltham, Mass.) was set up and used as a screening assay. In brief, 5 µl of periplasmic extract of individual Nanobody clones were incubated with 0.15 µM HuCTLA4-HuIgG1 Fc, 0.10 µM biotinylated HuCD80-MuIgG2a Fc, streptavidin coated donor beads and anti-human IgG1 Fc Nanobody coupled acceptor alphascreen beads. The mouse monoclonal antibody BNI3, known to inhibit the CTLA4/CD80 interaction, was used as a positive control. Assays were read in an Envision alphascreen option fitted multimode reader (Perkin Elmer). Individual clones were scored as putative CTLA4/CD80 interaction inhibiting if the presence of the periplasmic extract decreased the fluorescent signal of the acceptor beads.

EXAMPLE 51

CTLA4-Ig Binding Nanobody Expression and Purification

Selected CTLA4/CD80 interaction inhibiting Nanobodies were expressed in the periplasmic space of E. coli as c-myc, His6-tagged proteins in a culture volume of ~200 mL. Expression was induced by addition of 1 mM IPTG and allowed to continue for 4 h at 37° C. Cells were harvested by centrifugation and periplasmic extracts were prepared. These extracts were used as starting material for immobilized metal affinity chromatography (IMAC). Nanobodies were eluted from the column with 150 mM imidazole and subsequently subjected to gel filtration to PBS. Total yield and yield per liter of cell culture are listed in Table C-10.

SDS-PAGE of purified Nanobodies is shown in FIG. 30.

EXAMPLE 52

Ranking CTLA4-Fc/CD80-Fc Interaction Inhibition Potency of Nanobodies Using Alphascreen In order to determine which Nanobodies could inhibit the interaction of CTLA4 with CD80 most efficiently, serial dilutions of purified Nanobodies were prepared and tested in the same alphascreen assay as used for screening periplasmic extracts (as described in Example 50). Table C-11 summarizes the IC50 value of selected Nanobodies in this assay, clearly showing a range of potencies.

EXAMPLE 53

Generation of Human and Cynomolgus CTLA4 Overexpressing Stable Cell Lines

To verify if CTLA4-Ig binding Nanobody clones could bind to the native form of either the human or cynomolog monkey CTLA4 antigen, transfected cells stably expressing high levels of either human or cynomolgus monkey CTLA4 on the cell membrane were generated. These clones were generated by transfecting CHO-K1 cells with either full-length human CTLA4 cDNA cloned into pCI-Neo (Promega, Madison, Wis.), where the intracellular position Y201 was mutated to valine in order to ensure retention of the protein on the extracellular membrane (Chuang et al. J. Immunol. 159: 144, 1997), or the same human CTLA4 cDNA where three extracellular domain positions were mutated to the corresponding cynomolgus monkey CTLA4 extracellular domain amino acids (S13N, I17T and L105M; U.S. Pat. No. 6,682,736).

Introduction of linearized endotoxin-free plasmid DNA and selection for stable transfected cells was performed according to standard transfection and antibiotic selection methods. Individual high CTLA4 expressing transfectants were cloned from the bulk antibiotic resistant CHO cell population by staining the transfected CHO cells populations using the viability dye TOPRO3, PE labeled BNI3 antibody (BD Biosciences, San Jose, Calif., Cat #555853)) and sorting individual live (TOPRO3 negative) highly PE fluorescent cells into microtiter plate wells containing selection medium. Outgrowing clones were expanded and re-screened in FACS for homogeneous and high level CTLA4 expression using PE labeled BNI3.

EXAMPLE 54

Binding of the CTLA4-Ig Binding Nanobodies to Human and Cyno CTLA4 in FACS

To verify if CTLA4-Ig binding clones which inhibit the interaction of CTLA4 with CD80-Ig could also bind to the native form of the antigen, serial dilutions of purified protein preparations of such clones were allowed to bind to CHO cells expressing either human or cynomolgus monkey CTLA4 (see Example 53). Binding of putative CTLA4 reactive Nanobodies clones was detected using unlabeled anti-c-myc tag mouse monoclonal antibody 9E10, followed by a phycoerythrin conjugated F(ab')2 derived from goat-anti-mouse IgG (human and bovine crossabsorbed), and read on a BD FACSarray instrument. Dead cells were excluded from the analysis by gating out TOPRO3 vital dye positive scoring cells. Binding of the Nanobodies to cells was evaluated in BD FACSarray control software as PE channel histograms. Based on these FACS experiments, all CTLA4-Ig binding Nanobody clones found to be CD80 interaction inhibitory in alphascreen, also bound cell expressed CTLA4. Both cynomolgus crossreactive as well as essentially non-crossreactive human CTLA4 transfectant binding clones were identified by comparing the mean fluorescence intensity curve of serial dilutions of Nanobody between human and cynomologus CTLA4 transfected CHO cells. Table C-11 summarizes the IC50 value of selected Nanobodies in this assay.

EXAMPLE 55

Inhibition of CTLA4/CD80-Fc Interaction in FACS

The potency of selected Nanobodies to inhibit the interaction of CTLA4 with CD80 was also ranked using FACS based screening method. In brief, serial dilutions of purified Nanobodies were prepared and incubated at 4° C. with either human or cynomolgus CTLA4 overexpressing stable transfectants (see Example 53). To this suspension, HuCD80-Hu IgG1 Fc fusion protein was added to a concentration of 10 nM (final concentration) 20 minutes after Nanobody incubation had started. This concentration was previously determined to be the minimal amount required to saturate all CD80 binding sites on both human and cyno CTLA4 expressing CHO cell clones in the absence of any CTLA4 interaction blocking proteins. After an additional 30 minutes incubation, cells were washed and cell-bound HuCD80-Hu Fc was detected using a phycoerythrin labeled F(ab')$_2$ fragment of goat anti human IgG Fc (Jackson Immunoresearch Laboratories, Cat #109-116-170). Dead cells were stained by including TOPRO3 vital dye in the final resuspension buffer. All samples were read on a BD FACSarray instrument. Dead cells were excluded from the analysis by gating out TOPRO3 vital dye positive scoring cells. Inhibition of CD80-Fc binding to cell-displayed CTLA4 by these Nanobodies was evaluated in BD FACSarray control software as PE channel histograms. Results are summarized as mean fluorescence values of these histograms as a function of Nanobody concentration in FIGS. 31, 32 and 33.

EXAMPLE 56

Affinity Determination of CTLA4 Binding Nanobodies

Affinity constants (Kd) of individual purified Nanobody clones were determined by surface plasmon resonance on a Biacore T100 instrument. In brief, HuCTLA4-HuIgG1 or HuCD28-HuIgG1 were amine-coupled to a CM5 sensor chip at densities of 740-1700 RU. Remaining reactive groups were inactivated using ethanolamine. Nanobody binding was assessed at concentrations varying from 500 to 0.33 nM. Each sample was injected for 2 min at a flow rate of 45 µl/min to allow for binding to chip-bound antigen. Next, binding buffer without Nanobody was sent over the chip at the same flow rate to allow for dissociation of bound Nanobody. After 2 min, remaining bound analyte was removed by injecting regeneration solution (10 mM Glycine/HCl pH 1.5). Binding curves obtained at different concentrations of Nanobody were used to calculate $K_D$ values. For some clones, only a single undetermined concentrations of Nanobody was injected. For these clones, only off-rates could be determined.

$K_D$, $k_{on}$ and $k_{off}$ values of selected Nanobody clones are shown in Table C-11.

EXAMPLE 57

Cell-Stimulation Assays by CTLA4 Binding Nanobodies

Purified Nanobodies were tested in human PBMC and whole blood T-cell stimulation assays (as described in U.S. Pat. No. 6,682,736).

Briefly, fresh peripheral blood were collected from healthy donors in heparin anticoagulant containing vacutainers. Blood was then diluted with RPMI1640 medium containing penicillin, streptomycin, 100 ng/ml of Staphylococcal enterotoxin A from staphyloccocus aureus (SEA, Sigma-Aldrich, St. Louis, Mo., Cat # S9399) and aliquotted in 96-well microtiter plates which had been coated overnight with 60 ng/well of mitogenic mouse-anti-human anti-CD3 (clone OKT3, eBioscience, San Diego, Calif., Cat #16-0037-85).

Alternatively, PBMC were isolated from freshly drawn heparin anticoagulated blood or buffy coats using a standard Ficoll gradient, resuspended in medium containing SEA as described above and aliquotted into a CD3 coated microtiter plate.

Serial dilutions of CTLA4 neutralizing antibody BNI3, mouse IgG2a isotype control antibody or endotoxin-free CTLA4 reactive Nanobody preparations were added to the wells of either whole blood or PBMC assay. Plates were incubated for 48, 72 or 96 hours at 37° C. under 5% CO$_2$/100% humidity atmosphere. Cell-free supernatant from all wells were collected at each timepoint and frozen at −80° C. until the last timepoint was harvested and frozen. IL-2 concentration in these conditioned supernatants was then analyzed after simultaneous thawing of all timepoint samples of any given assay at fixed 1/10 or 1/20 dilutions, using a standard IL-2 sandwich ELISA (Invitrogen, Carlsbad, Calif., Cat # CHC1244).

CTLA4 neutralization in these assay gave rise to increased levels of IL-2 production. Relative potency of Nanobody clones and reference antibody could be scored and ranked according to the IC50 values of the titration curves obtained. FIG. 34 shows representative IL-2 ELISA results, expressed as optical density.

EXAMPLE 58

Formatting of CTLA4 Neutralizing Nanobodies

Next, Nanobodies binding CTLA4 and neutralizing its activity in bioassays were formatted such that they gain binding affinity (avidity) and potency in bioassays.

For example, CTLA4 neutralizing monomeric Nanobodies were reformatted into bivalent CTLA4 neutralizing constructs by standard PCR-based DNA manipulation, resulting in an *E. coli* expression plasmid encoding a fusion protein comprising two identical copies of the same Nanobody clone, linked in tandem via a gly/ser linker.

Alternatively, two identical CTLA4 binding Nanobody clones were reformatted similarly into a trivalent fusion proteins, starting with the bivalent format as described above, but fusing this further to another C-terminal Nanobody clone which binds human serum albumin.

These two bi- or trivalent formats Nanobodies were expressed in *E. coli* and subsequently purified using methods identical to those described in Example 51.

Finally, some CTLA4 neutralizing Nanobody clones were reformatted into a bivalent format essentially identical to that described above, but further fused C-terminally to full-length human serum albumin. These fusion protein encoding cassettes were cloned into a *Pichia pastoris* expression vector which allows for inducible protein expression, secreted into the culture medium. Such fusion proteins were produced according to standard methods and purified from conditioned medium using protein A (GE Healthcare Biosciences, Uppsala, Sweden) chromatography for Nanobody clones known to bind protein A, or Blue Sepharose (GE Healthcare Biosciences, Uppsala, Sweden) for Nanobody clones that do not bind protein A, all according to the manufacturer's instructions.

Table B-10 lists the sequences of such bivalent, trivalent and bivalent-albumin fusion proteins.

EXAMPLE 59

Potency of Multivalent CTLA4 Neutralizing Nanobodies as Determined in Alphascreen Nanobodies neutralizing CTLA4 and formatted into various multivalent formats as described in Example 58 were titered in a CTLA4-Ig/CD80-Ig interaction alphascreen as described in Example 52. FIG. 35 shows the results of a representative assay where the potency of a monovalent Nanobody clone is compared to that of the multivalently formatted same Nanobody clone. Table C-12 summarizes the IC50 values of selected multivalent Nanobodies.

EXAMPLE 60

Potency of Multivalent CTLA4 Neutralizing Nanobodies as Detected in FACS

Nanobodies neutralizing CTLA4 and formatted into various multivalent formats as described in example 58 were titered in a CTLA4 transfected CHO cell line/CD80-Ig interaction FACS assay as described in Example 55. FIG. 36 shows the results of a representative assay where the potency of a monovalent Nanobody clone is compared to that of the multivalently formatted same Nanobody clone. Table C-13 summarizes the IC50 values of selected multivalent Nanobodies.

EXAMPLE 61

Binding Affinity of Formatted CTLA4 Neutralizing Nanobodies as Measured in BIAcore The CTLA4-Ig binding affinity/avidity of multivalent Nanobodies as described in example 58 was analyzed in BIAcore as described in Example 56. FIG. 37 shows the results of a representative assay where the association and dissociation of monovalent Nanobody clones was compared to those of the corresponding multivalently formatted Nanobodies. Table C-14 summarizes the off-rates values measured for selected multivalent Nanobodies. To calculate apparent gain of affinity (avidity), the ratio of the formatted clone's off-rate versus the monovalent clone's off-rate was determined. For 11F1, no direct comparison could be made for the 300-375 s dissociation period as most monovalent material was dissociated at that time, so the 300-375 s dissociation phase kinetics were compared to the 60 s dissociation phase of the monomer.

EXAMPLE 62

Potency of Multivalent CTLA4 Neutralizing Nanobodies as Detected in Bioassay

The potency gain of multivalent formatted Nanobodies was compared versus the original monovalent Nanobody in a T-cell stimulation bioassay, executed as described in Example 57. FIG. 38 shows the results of a representative assay where the potency of a monovalent Nanobody clone is compared to that of the multivalently formatted same Nanobody clone. As can readily be observed, formatting of a neutralizing anti-CTLA4 Nanobody such as 11F1 results in an increase in potency in bioassay.

EXAMPLE 63

CTLA4 neutralizing Nanobodies can be Humanized without Significant Loss of Functionality FIGS. 39 and 40 show the amino acid sequences of respectively Nanobody clones 11F1 and 11E3 aligned with multiple human immunoglobulin germline sequences. Multiple amino acid differences between the Nanobody clones and human germline are thus made evident. In order to reduce the potential immunogenicity of Nanobodies administered to human recipients, Nanobody sequences can be modified to resemble the human germline more than the initial "wild type" sequence, a process termed humanization. However, substitution of certain critical amino acids in Nanobody sequences can lead to reduced or completely abrogated antigen binding.

Multiple partially humanized Nanobody variant sequences were generated from each clone, as depicted in FIGS. 41 and 42. Variant sequences were prepared by standard site-directed mutagenesis methods, well known to those skilled in the art. Next, protein was produced and purified from these variants using the same methods as described in the pervious examples, and tested for their potential to inhibit the interaction between CTLA4-Ig and CD80-Ig in alphascreen, as described in Example 52. Results are shown in Table C-15. A "loss factor" was calculated by taking the ratio of the wild type molecule IC50 value and the variant's IC50 value.

As can readily be observed, humanization of clone 11F1 does not result in significant loss of potency. Therefore, a variant uniting all mutations in one humanized variant can be expected to retain full potency, while also being very unlikely to induce an immune response in man. A mutation present in all humanized variants of 11E3 results in a 10-20 fold range potency loss, but only one variant showed loss of all inhibition potency. Additional variants containing fewer mutations than the "basic" set contained within all variants listed here (essentially single amino acid reversals to the wild type Nanobody clone sequence) can therefore be designed and tested as described here to determine which mutation(s) is (are) responsible for the overall 10× drop in potency. Then, either all mutations listed and tested here can be united into a single humanized variant, or all individual mutations present in variants 1, 2 and 4 can be used in combination with the mutations found not the result in 10× potency drops in the less humanized "basic" set of mutations not resulting in 10× potency drops.

EXAMPLE 64

Humanized CTLA4 Neutralizing Nanobodies can be Formatted

Humanized Nanobody sequences found not to result in large losses of affinity and/or potency, as described in Example 63, can be formatted into bivalent, trivalent or higher valency multivalent and/or multispecific Nanobodies, as described in Example 58. These can be produced, purified and tested for gain of affinity/potency using the methods described in Examples 58 to 62. One can, for example, combine the gain of affinity/potency of formatted Nanobodies and the benefit of reduced potential to induce an anti-drug immune response in man in a single molecule. This type of molecule is preferred over molecules with lesser potency and/or shorter half-lives and/or higher anticipated immunogenicity.

EXAMPLE 65

In Vivo Efficacy Testing of CTLA4 Binding Nanobodies

In vivo neutralization of CTLA4 gives rise to increased levels of T-cell activity. One indirect method of measuring this increase is via determination of humoral (B-cell) immune responses following an antigenic challenge, as this reflects increased T-cell help (Keler et al., J. Immunol. 171: 6251, 2003). Alternatively, one can compare the relative frequency of IL-2 producing T-cells between treated and control animals.

Therefore, the therapeutic efficacy of CTLA4 neutralizing Nanobodies having crossreactivity with non-human primate CTLA4 is determined by administering the Nanobodies to primates undergoing an immunization scheme. The antigen used for the purpose may be either a vaccine known to be efficacious by itself (i.e. hepatitis vaccine, tetanus toxoid vaccine) or a vaccine which is less than fully protective when used by itself (i.e. certain cancer vaccines) (Keler et al.).

Anti-vaccine serum titers can then be determined in ELISA and compared with primates that did not receive CTLA4 neutralizing Nanobodies. Alternatively, increased T-cell reactivity towards the vaccine antigen can be determined by in vitro restimulating PBMC with antigen and comparing the number of IL-2 producing T-cells in ELIspot. Both the required purified vaccine antigen as well as monkey IL-2 ELISpot assays are commercially available (Rollier et al. 2007, Hepatology 45: 602).

TABLE B-1

| Preferred Nanobodies against B7-1 and/or B7-2<br><Name, SEQ ID #; PRT (protein); -><br>Sequence |
|---|
| >CD8086PMP1A1, SEQ ID NO: 266; PRT; -><br>EVQLVESGGGLVQAGGSLRLSCAASGFTDGIDAMGWFRQAPGKEREFVASIGRSGNSATNVDSVKGRFTISR<br>DNAKNTMYLQMNSLKPEDTAGYYCAAATRRAYLPIRIRDYIYWGQGTQVTVSS |
| >CD8086PMP1A3, SEQ ID NO: 267; PRT; -><br>EVQLVESGGGLVQAGGSLRLSCAASGPTSSSYSMGWFRQAPGKEREFVAAINWSHGVTYYADSVKGRFTISR<br>DIAKNTVYLQMNSLKPEDTAVYYCAANEYGLGSSIYAYKHWGQGTQVTVSS |
| >CD8086PMP1B2, SEQ ID NO: 268; PRT; -><br>EVQLVESGGGLVQAGGSLRLSCAASGRSFSSYVMGWFRQAPGKEREFVAAIIGRDIGTYYADSVKGRFTISR<br>DNAKTTVYLQMNALKPEDTAVYYCAADSRSRLSGIRSAYDYWGQGTVTVSS |
| >CD8086PMP1C5, SEQ ID NO: 269; PRT; -><br>EVQLVESGGGSVQAGGSLRLSCAATGRTFSSYGMGWFRQAPGKEREFVAAIHWNSGITYYADSVKGRFTISR<br>DNAKNTVYLQMSSLKPEDTAVYICAASSKGLTGTIRAYDDWGQGTQVTVSS |
| >CD8086PMP1C7, SEQ ID NO: 270; PRT; -><br>EVQLVESGGGLVQAGGSLRLSCAASGRTFSDYAAGWFRQAPGKERDFVAAINWSGGSTYYADSVKGRFTISR<br>DNAKNTVYLQMNSLKPEDTAVYYCASGWGRTTVLADTVXYWGQGTQVTVSS |
| >CD8086PMP1C9, SEQ ID NO: 271; PRT; -><br>EVQLVESGGGLVQAGGSLRLSCAASGFXXGIDAMGWFRQAPGKEREFVASIXRSGGXATXADSVKGRFTISR<br>DNAKNTMYLQMNXLKPEDTAGYYCAAATRRPYLPIRISRLYLXGPGXHXVTVSS |
| >CD8086PMP1D1, SEQ ID NO: 272; PRT; -><br>EVQLVESGGGLVQAGGSLRLSCAASGRTFSSKAMGWFRQAPGKERDFVAAITWSGGSTYYADHVKGRFTISR<br>DNAKNTVYLQMNSLKPEDTAVYYCATNPYGLGQVGYDYWGQGTQVTVSS |
| >CD8086PMP1D4, SEQ ID NO: 273; PRT; -><br>EVQLVESGGGLVQAGGSLRLSCAASGFTDGIDAMGWFRQAPGKEREFVASIGRSGGSATNADSVKGRFTISR<br>DNAKNTMYLQMNSLKPEDTAGYYCAAATRRPYLPIRIRDYIYWGQGTQVTVSS |
| >CD8086PMP1E11, SEQ ID NO: 274; PRT; -><br>EVQLVESGGGLVQPGGSLRLSCAASGFTLDYSAIGWFRQAPGKEREGVSYISSSDGSTYYADSVEGRFTISR<br>DNAKNTLYLQMNSLKPEDTAVYYCAAGGPFTVSTMPWLANYWGQGTQVTVSS |
| >CD8086PMP1F12, SEQ ID NO: 275; PRT; -><br>EVQLVESGGGLVQAGGSLRLACAASGLSFSFYTMGWFRQAPGEERDFVAAINWSGGSTLYAESVKGRFTISR<br>DNAKNTVYLQMNSLKPEDTAVYYCAAVRSVGRTYWTRALEYNYWGQGTQVTVSS |
| >CD8086PMP2A7, SEQ ID NO: 276; PRT; -><br>EVQLVESGGGLVQAGGSLRLSCAASGRTFSSKAMGWFRQAPGKERDFVAAITWSGGSTYYADHVKGRFTISR<br>DNAKNTVYLQMNSLKPEDTAVYYCATNPYGLGQVGYDYWGQGTQVTVSS |
| >CD8086PMP2B10, SEQ ID NO: 277; PRT; -><br>EVQLVESGGGLVQAGGSLRLSCTGSQISFSDNTMNWYRQVPGKQRELVASLSIFGATGYADSVKGRFTISRD<br>IAGNTVYLQMNDLKIEDTAVYYCKLGPVRRSRLEYWGQGTQVTVSS |
| >CD8086PNP2B4, SEQ ID NO: 278; PRT; -><br>EVQLVESGGGLVQAGGSLRLSCAASGSIFSIYTMGWYRQAPGEQRELVAAITSGGSTNYADSVKGRFTISRD<br>NAKNTVYLQMNSLKPEDTAVYYCNAIAHEEGVYRWDFWGQGTQVTVSS |
| >CD8086PNP2C9, SEQ ID NO: 279; PRT; -><br>EVQLVESGGGLVQAGGSLRLSCAASGSIFSIYAMGWYRQAPGKQRELVAAITSGGSTNYADSVMGRFTISRD<br>NAKNTVYLQMNSLKPEDTAVYYCNANAHEEGVYRWDFWGQGTQVTVSS |
| >CD8086PMP2E6, SEQ ID NO: 280; PRT; -><br>EVQLVESGGGLVQAGGSLRLSCAASGSIFSIYDMGWYRQAPGKQRVLVATITSGGSTNYADSVKGRFTISRD<br>DAKNTVYLQMNSLKPEDTAVYYCNAIAHEEGVYRWDFWGQGTQVTVSS |

TABLE B-1-continued Preferred Nanobodies against B7-1 and/or B7-2
<Name, SEQ ID #; PRT (protein); ->
Sequence >CD8086PMP2F5, SEQ ID NO: 281; PRT; ->
EVQLVKSGGGLVQAGGSLRLSCAASGSIFSIYDMGWYRQAPGKQRELVAAITSGGSTNYADSVKGRFTISRD
NAKNTVYLQMNSLKPEDTAVYYCNAIAYEEGVYRWDFWGQGTQVTVSS >CD8086PMP2G4, SEQ ID NO: 282; PRT; ->
EVQLVESGGGLVQAGGSLRLSCAASGSIFSIYDMGWYRQAPGKQRVLVATITSGGSTNYADSVKGRFTISRD
NAKNTVYLQMNSLKPEDTAVYYCNAIAHEEGVYRWDFWGQGTQVTVSS >CD8086PMP2G8, SEQ ID NO: 283; PRT; ->
EVQLVKSGGGLVQPGGSLRLSCAASGFIFSIYAMGWYRQAPGKQRELVAAITSGGSTNYADSVKGRFAISRD
NAKNTVYLQMNSLKPEDTAVYYCNANAHEEGVYRWDFWGQGTQVTVSS >CD8086PMP2H11, SEQ ID NO: 284; PRT; ->
EVQLVESGGGLVQAGGSLRLSCAASGSIFSIYTMGWYRQAPGKQRELVAAITSGGSTNYADSVKGRFTISRD
NAKNTVYLQMNSLKPEDTAVYYCNAIAHEEGVYRWDFWGQGTQVTVSS >CD8086PMP2H9, SEQ ID NO: 285; PRT; ->
EVQLVESGGGLVQAGGSLRLSCTASGSIFSIDAMGWYRQAPGKQRELVAHISSGGSTNYADSVKGRFTISRD
NAKNTVYLQMNSLKPEDTAVYYCTVPRETGWDGDYWGQGTQVTVSS

TABLE B-2

Preferred Nanobodies against B7-1 and/or B7-2 and human serum albumin
<Name, SEQ ID #; PRT (protein); ->
Sequence >CD8086PMP1A1-ALB1, SEQ ID NO: 286; PRT; ->
EVQLVESGGGLVQAGGSLRLSCAASGFTDGIDAMGWFRQAPGKEREFVASIGRSGNSATNVDSVKGRFTISR
DNAKNTMYLQMNSLKPEDTAGYYCAAATRRAYLPIRIRYIYWGQGTQVTVSSGGGGSGGGSEVQLVESGGG
LVQPGNSLRLSCAASGFTFRSFGMSWVRQAPGKEPEVSSISGSGSDTLYADSVKGRFTISRDNAKTTLYLQ
MNSLKPEDTAVYYCTIGGSLSRSSQGTQVTVSS >CD8086PMP1A3-ALB1, SEQ ID NO: 287; PRT; ->
EVQLVESGGGLVQAGGSLRLSCAASGPTSSSYSMGWFRQAPGKEREFVAAINWSHGVTYYADSVKGRFTISR
DIAKNTVYLQMNSLKPEDTAVYYCAANEYGLGSSIYAYKHWGQGTQVTVSSGGGGSGGGSEVQLVESGGGLV
QPGNSLRLSCAASGFTFRSFGMSWVRQAPGKEPEWVSSISGSGSDTLYADSVKGRFTISRDNAKTTLYLQMN
SLKPEDTAVYYCTIGGSLSRSSQGTQVTVSS >CD8086PMP1B2-ALB1, SEQ ID NO: 288; PRT; ->
EVQLVESGGGLVQAGGSLRLSCAASGRSFSSYVMGWFRQAPGKEREFVAAIIGRDIGTYYADSVKGRFTISR
DNAKTTVYLQMNALKPEDTAVYYCAADSRSRLSGIRSAYDYWGQGTVTVSSGGGGSGGGSEVQLVESGGGLV
QPGNSLRLSCAASGFTFRSFGMSWVRQAPGKEPEWVSSISGSGSDTLYADSVKGRFTISRDNAKTTLYLQMN
SLKPEDTAVYYCTIGGSLSRSSQGTQVTVSS >CD8086PMP1C5-ALB1, SEQ ID NO: 289; PRT; ->
EVQLVESGGGSVQAGGSLRLSCAATGRTFSSYGMGWFRQAPGKEREFVAAIHWNSGITYYADSVKGRFTISR
DNAKNTVYLQMSSLKPEDTAVYICAASSKGLTGTIRAYDDWGQGTQVTVSSGGGGSGGGSEVQLVESGGGLV
QPGNSLRLSCAASGFTFRSFGMSWVRQAPGKEPEWVSSISGSGSDTLYADSVKGRFTISRDNAKTTLYLQMN
SLKPEDTAVYYCTIGGSLSRSSQGTQVTVSS >CD8086PMP1C7-ALB1, SEQ ID NO: 290; PRT; ->
EVQLVESGGGLVQAGGSLRLSCAASGRTFSDYAAGWFRQAPGKERDFVAAINWSGGSTYYADSVKGRFTISR
DNAKNTVYLQMNSLKPEDTAVYYCASGWGRTTVLADTVXYWGQGTQVTVSSGGGGSGGGSEVQLVESGGGLV
QPGNSLRLSCAASGFTFRSFGMSWVRQAPGKEPEWVSSISGSGSDTLYADSVKGRFTISRDNAKTTLYLQMN
SLKPEDTAVYYCTIGGSLSRSSQGTQVTVSS >CD8086PMP1C9-ALB1, SEQ ID NO: 291; PRT; ->
EVQLVESGGGLVQAGGSLRLSCAASGFXXGIDAMGWFRQAPGKEREFVASIXRSGGXATXADSVKGRFTISR
DNAKNTMYLQMNXLKPEDTAGYYCAAATRRPYLPIRISRLYLXGPGXHXVTVSSGGGGSGGGSEVQLVESGG
GLVQPGNSLRLSCAASGFTFRSFGMSWVRQAPGKEPEWVSSISGSGSDTLYADSVKGRFTISRDNAKTTLYL
QMNSLKPEDTAVYYCTIGGSLSRSSQGTQVTVSS >CD8086PMP1D1-ALB1, SEQ ID NO: 292; PRT; ->
EVQLVESGGGLVQAGGSLRLSCAASGRTFSSKAMGWFRQAPGKERDFVAAITWSGGSTYYADHVKGRFTISR
DNAKNTVYLQMNSLKPEDTAVYYCATNPYGLGQVGYDYWGQGTQVTVSSGGGGSGGGSEVQLVESGGGLVQP
GNSLRLSCAASGFTFRSFGMSWVRQAPGKEPEWVSSISGSGSDTLYADSVKGRFTISRDNAKTTLYLQMNSL
KPEDTAVYYCTIGGSLSRSSQGTQVTVSS >CD8086PMP1D4-ALB1, SEQ ID NO: 293; PRT; ->
EVQLVESGGGLVQAGGSLRLSCAASGFTDGIDAMGWFRQAPGKEREFVASIGRSGGSATNADSVKGRFTISR
DNAKNTMYLQMNSLKPEDTAGYYCAAATRRPYLPIRIRDYIYWGQGTQVTVSSGGGGSGGGSEVQLVESGGG TABLE B-2-continued Preferred Nanobodies against B7-1 and/or B7-2 and human serum albumin
<Name, SEQ ID #; PRT (protein); ->
Sequence LVQPGNSLRLSCAASGFTFRSFGMSWVRQAPGKEPEWVSSISGSGSDTLYADSVKGRFTISRDNAKTTLYLQ
MNSLKPEDTAVYYCTIGGSLSRSSQGTQVTVSS >CD8086PMP1E11-ALB1, SEQ ID NO: 294; PRT; ->
EVQLVESGGGLVQPGGSLRLSCAASGFTLDYSAIGWFRQAPGKEREGVSYISSSDGSTYYADSVEGRFTISR
DNAKNTLYLQMNSLKPEDTAVYYCAAGGPFTVSTMPWLANYWGQGTQVTVSSGGGGSGGGSEVQLVESGGGL
VQPGNSLRLSCAASGFTFRSFGMSWVRQAPGKEPEWVSSISGSGSDTLYADSVKGRFTISRDNAKTTLYLQM
NSLKPEDTAVYYCTIGGSLSRSSQGTQVTVSS >CD8086PMP1F12-ALB1, SEQ ID NO: 295; PRT; ->
EVQLVESGGGLVQAGGSLRLACAASGLSFSFYTMGWFRQAPGEERDFVAAINWSGGSTLYAESVKGRFTISR
DNAKNTVYLQMNSLKPEDTAVYYCAAVRSVGRTYWTRALEYNYWGQGTQVTVSSGGGGSGGGSEVQLVESGG
GLVQPGNSLRLSCAASGFTFRSFGMSWVRQAPGKEPEWVSSISGSGSDTLYADSVKGRFTISRDNAKTTLYL
QMNSLKPEDTAVYYCTIGGSLSRSSQGTQVTVSS >CD8086PMP2A7-ALB1, SEQ ID NO: 296; PRT; ->
EVQLVESGGGLVQAGGSLRLSCAASGRTFSSKAMGWFRQAPGKERDFVAAITWSGGSTYYADHVKGRFTISR
DNAKNTVYLQMNSLKPEDTAVYYCATNPYGLGQVGYDYWGQGTQVTVSSGGGGSGGGSEVQLVESGGGLVQP
GNSLRLSCAASGFTFRSFGMSWVRQAPGKEPEWVSSISGSGSDTLYADSVKGRFTISRDNAKTTLYLQMNSL
KPEDTAVYYCTIGGSLSRSSQGTQVTVSS >CD8086PMP2B10-ALB1, SEQ ID NO: 297; PRT; ->
EVQLVESGGGLVQAGGSLRLSCTGSQISFSDNTMNWYRQVPGKQRELVASLSIFGATGYADSVKGRFTISRD
IAGNTVYLQMNDLKIEDTAVYYCKLGPVRRSRLEYWGQGTQVTVSSGGGGSGGGSEVQLVESGGGLVQPGNS
LRLSCAASGFTFRSFGMSWVRQAPGKEPEWVSSISGSGSDTLYADSVKGRFTISRDNAKTTLYLQMNSLKPE
DTAVYYCTIGGSLSRSSQGTQVTVSS >CD8086PMP2B4-ALB1, SEQ ID NO: 298; PRT; ->
EVQLVESGGGLVQAGGSLRLSCAASGSIFSIYTMGWYRQAPGEQRELVAAITSGGSTNYADSVKGRFTISRD
NAKNTVYLQMNSLKPEDTAVYYCNAIAHEEGVYRWDFWGQGTQVTVSSGGGGSGGGSEVQLVESGGGLVQPG
NSLRLSCAASGFTFRSFGMSWVRQAPGKEPEWVSSISGSGSDTLYADSVKGRFTISRDNAKTTLYLQMNSLK
PEDTAVYYCTIGGSLSRSSQGTQVTVSS >CD8086PMP2C9-ALB1, SEQ ID NO: 299; PRT; ->
EVQLVESGGGLVQAGGSLRLSCAASGSIFSIYAMGWYRQAPGKQRELVAAITSGGSTNYADSVMGRFTISRD
NAKNTVYLQMNSLKPEDTAVYYCNANAHEEGVYRWDFWGQGTQVTVSSGGGGSGGGSEVQLVESGGGLVQPG
NSLRLSCAASGFTFRSFGMSWVRQAPGKEPEWVSSISGSGSDTLYADSVKGRFTISRDNAKTTLYLQMNSLK
PEDTAVYYCTIGGSLSRSSQGTQVTVSS >CD8086PMP2E6-ALB1, SEQ ID NO: 300; PRT; ->
EVQLVESGGGLVQAGGSLRLSCAASGSIFSIYDMGWYRQAPGKQRVLVATITSGGSTNYADSVKGRFTISRD
DAKNTVYLQMNSLKPEDTAVYYCNAIAHEEGVYRWDFWGQGTQVTVSSGGGGSGGGSEVQLVESGGGLVQPG
NSLRLSCAASGFTFRSFGMSWVRQAPGKEPEWVSSISGSGSDTLYADSVKGRFTISRDNAKTTLYLQMNSLK
PEDTAVYYCTIGGSLSRSSQGTQVTVSS >CD8086PMP2F5-ALB1, SEQ ID NO: 301; PRT; ->
EVQLKSGGGLVQAGGSLRLSCAASGSIFSIYDMGWYRQAPGKQRELVAAITSGGSTNYADSVKGRFTISRD
NAKNTVYLQMNSLKPEDTAVYYCNAIAYEEGVYRWDFWGQGTQVTVSSGGGGSGGGSEVQLVESGGGLVQPG
NSLRLSCAASGFTFRSFGMSWVRQAPGKEPEWVSSISGSGSDTLYADSVKGRFTISRDNAKTTLYLQMNSLK
PEDTAVYYCTIGGSLSRSSQGTQVTVSS >CD8086PMP2G4-ALB1, SEQ ID NO: 302; PRT; ->
EVQLVESGGGLVQAGGSLRLSCAASGSIFSIYDMGWYRQAPGKQRVLVATITSGGSTNYADSVKGRFTISRD
NAKNTVYLQMNSLKPEDTAVYYCNAIAHEEGVYRWDFWGQGTQVTVSSGGGGSGGGSEVQLVESGGGLVQPG
NSLRLSCAASGFTFRSFGMSWVRQAPGKEPEWVSSISGSGSDTLYADSVKGRFTISRDNAKTTLYLQMNSLK
PEDTAVYYCTIGGSLSRSSQGTQVTVSS >CD8086PMP2G8-ALB1, SEQ ID NO: 303; PRT; ->
EVQLKSGGGLVQPGGSLRLSCAASGFIFSIYAMGWYRQAPGKQRELVAAITSGGSTNYADSVKGRFAISRD
NAKNTVYLQMNSLKPEDTAVYYCNANAHEEGVYRWDFWGQGTQVTVSSGGGGSGGGSEVQLVESGGGLVQPG
NSLRLSCAASGFTFRSFGMSWVRQAPGKEPEWVSSISGSGSDTLYADSVKGRFTISRDNAKTTLYLQMNSLK
PEDTAVYYCTIGGSLSRSSQGTQVTVSS >CD8086PMP2H11-ALB1, SEQ ID NO: 304; PRT; ->
EVQLVESGGGLDVQAGGSLRLSCAASGSIFSIYTMGWYRQAPGKQRELVAAITSGGSTNYADSVKGRFTISRD
NAKNTVYLQMNSLKPEDTAVYYCNAIAHEEGVYRWDFWGQGTQVTVSSGGGGSGGGSEVQLVESGGGLVQPG
NSLRLSCAASGFTFRSFGMSWVRQAPGKEPEWVSSISGSGSDTLYADSVKGRFTISRDNAKTTLYLQMNSLK
PEDTAVYYCTIGGSLSRSSQGTQVTVSS >CD8086PMP2H9-ALB1, SEQ ID NO: 305; PRT; ->
EVQLVESGGGLVQAGGSLRLSCTASGSIFSIDAMGWYRQAPGKQRELVAHISSGGSTNYADSVKGRFTISRD
NAKNTVYLQMNSLKPEDTAVYYCTVPRETGWDCDYWGQGTQVTVSSGGGGSGGGSEVQLVESGGGLVQPGNS
LRLSCAASGFTFRSFGHSWVRQAPGKEPEWVSSISGSGSDTLYADSVKGRFTISRDNAKTTLYLQMNSLKPE
DTAVYYCTIGGSLSRSSQGTQVTVSS

TABLE B-3

Leader sequences and N-terminal sequences
<Name, SEQ ID #; PRT (protein); ->
Sequence > llama leader 1, SEQ ID NO: 306; PRT; ->
VKKLLFAIPLVVPFYAAQPAMA < llama leader 2, SEQ ID NO: 307; PRT; ->
VKKLLFAIPLVVPFYAAQPAIA < llama leader 3, SEQ ID NO: 308; PRT; ->
FELASVAQA < leader sequence, SEQ ID NO: 309; PRT; ->
MKKTAIAIAVALAGLATVAQA < leader sequence, SEQ ID NO: 310; PRT; ->
MKKTAIAFAVALAGLATVAQA < N-terminal sequence, SEQ ID NO: 311; PRT; ->
AAAEQKLISEEDLNGAAHHHHHH

TABLE B-4

Preferred Nanobodies against PD-1

>102C3, SEQ ID NO: 347; PRT; ->
EVQLVESGGGLVQAGKSLRLSCAASGSIFSIHAMGWFRQAPGKEREFVAA
ITWSGGITYYEDSVKGRFTISRDNAKNTVYLQMNSLKPEDTAIYYCAADR
AESSWYDYWGQGTQVTVSS

>102C12, SEQ ID NO: 348; PRT; ->
EVQLVESGGGLVQAGGSLRLSCAASGSIASIHAMGWFRQAPGKEREFVAV
ITWSGGITYYADSVKGRFTISRDNAKNTVYLQMNSLKPEDTAIYYCAGDK
HQSSWYDYWGQGTQVTVSS

>102E2, SEQ ID NO: 349; PRT; ->
EVQLVESGGGLVQAGGSLRLSCAASGSISSIHAMGWFRQAPGKEREFVAA
ITWSGGITYYADSLKGRFTISRDNAKNTGYLQMNSLKPEDTAIYYCAADR
AQSSWYDYWGQGTQVTVSS

>102E8, SEQ ID NO: 350 PRT; ->
EVQLVESGGGLVQAGGSLGLSCAASGSIFSINAMAWFRQAPGKEREFVAL
ISWSGGSTYYEDSVKGRFTISRDNAKNTVYLQMNSLKPEDTAIYYCAADR
VDSNWYDYWGQGTQVTVSS

>102H12, SEQ ID NO: 351; PRT; ->
EVQLVESGGGLVQAGGSLRLSCAASGRAFSSGTMGWFRRAPGKEREFVA
SIPWSGGRIYYADSVKGRFTISRDNAQNTVYLQMNSLKPEDTAVYYCAVK
ERSTGWDFASWGQCTQVTVSS

TABLE B-5

Preferred Nanobodies against PD-L1 (B7-H1)

>104D2, SEQ ID NO: 394; PRT; ->
EVQLVESGGGLVQPGGSLRLSCAASGFTLDYYAIGWFRQAPGKEREWASS
ISSSDGSTYYADSVKGRFTISRDNAKNTVFLQMNSLKPEDTAVYSCAASQ
APITIATMMKPFYDYWGQGTQVTVSS

>104F5, SEQ ID NO: 395; PRT; ->
EVQLVESGGGLVQPGGSLRLSCAASGFTLDYYAKCWFRQAPGKEREWVSC
ISSSDGSTYYADSVKGRFTISRDNAKNTVYLQMNSLKPEDTAVYFCAARH
GGPLTVEYFFDYWGQGTQVTVSS

>104E12, SEQ ID NO: 396; PRT; ->
EVQLVESGGGLVQPGGSLRLSCAASGFTFDYYAIGWFRQAPGKAREGVSC
ISGGDNSTYYADSVKGRFTISRDNAKNTVYLQMNSLKPEDTAVYYCATGG
WKYCSGYDPEYIYWGQGTQVTVSS

TABLE B-5-continued

Preferred Nanobodies against PD-L1 (B7-H1)

>104B10, SEQ ID NO: 397; PRT; ->
EVQLVESGGGLVQAGGSLRLSCAASGSTFSQYDVGWYRQAPGKQRELVA
FSSSGGRTIYPDSVKGRFTFSRDNTKNTVYLQMTSLKPEDTAVYYCKIDW
YLNSYWGQGTQVTVSS

>104F10, SEQ ID NO: 398; PRT; ->
EVQLVESGGGLVQAGGSLRLSCAASGVDASNSAMGWYRQAPGKQREWVAR
ITGGGLIAYTDSVKGRFTISRDNAKSTVYLQMNSLEPEDTAVYYCNTINS
RDGWGQGTQVTVSS

>104D7, SEQ ID NO: 399; PRT; ->
EVQLVESGGGLVQAGGSLTISCAASGITFSDSIVSWYRRARGKQREWVAG
ISNGGTTKYAESVLGRFTISRDNAKNNVYLQMNGLNPEDTAVYLCKVRQY
WGQGTQVTVSS

TABLE B-6

Preferred Nanobodies against PD-L2

>103A9, SEQ ID NO: 449; PRT; ->
EVQLVESGGGLVQAGGSLRLSCAASESTVLINAMGWYRQAPGKQRELVAS
ISSGGSTNYADSVKGRFTISRDNAKNTVYLQMNSLKPEDTAVYYCNADVY
PQDYGLGYVEGKVYYGHDYWGTGTLVTVSS

>103E2, SEQ ID NO: 450; PRT; ->
EVQLVESGGGLVQAGGSLRLSCAASGSTFSNYVSNYAMGWGRQAPGTQ
RELVASISNGDTTNYADSVKGRFTISRDNAKNTVYLQMNSLKPEDTAVYY
CFEHQVAGLTWGQGTQVTVSS

>103G12, SEQ ID NO: 451; PRT; ->
EVQLVESGGGLVQAGGSLRLSCVASGXALKIXVMGWYRQAPGKQRELV
AAITSGGRTNYSDSVKGRFTISGDNAXNTVYLQMNSLKSEDTAVYYCRE
WNSGYPPVDYWGQGTQVTVSS

>103F10, SEQ ID NO: 452; PRT; ->
EVQLVESGGGLVQAGGSLRLSCAASGRTFSSGTMGWFRRAPGKEREFV
ASIPWSGGRTYYADSVKDRFTISRDNAQNTVFLQMNSLKPEDTAVYYCAF
KERSTGWDFASWGQGIQVTVSS

>103E3, SEQ ID NO: 453; PRT; ->
EVQLVESGGGLVQTGGSLRLSCAASGFTLDYYGIGWFRQAPGKEREGVS
FISGSDGSTYYAESVKGRFTISRDKAKNTVYLQMNSLKPEDTAVYYCAAD
PWGPPSIATMTSYEYKHWGQGTQVTVSS

>103F6, SEQ ID NO: 454; PRT; ->
EVQLVESGGGLVQPGGSLRLSCAASGFTFSTYTMIWLRRAPGKGFEWV
STIDKDGNTNYVDSVKGRFAVSRDNTKNTLYLQMNSLKPEDTAMYYCTK
HGSSARGQGTRVTVSS

>103D3, SEQ ID NO: 455; PRT; ->
EVQLVESGGGLVEPGGSLRLSCVASGFTFSSYDMSWVRQAPGKGLE
WVSTINSGGGITYRGSVKGRFTISRDNAKNTLYLQMNSLKPEDTAVYY
CENGGSSYRRGQGTQVTVSS

TABLE B-7

Preferred Nanobodies against B7-H2 (ICOSL)

>95A6, SEQ ID NO: 505; PRT; ->
EVQLVESGGGLVQAGGSLRLSCALSGRAVSIAATAMGWYRQAPGKQRELV
AARWSGGSIQYLDSVKGRFTISRDNAKNTVYLQMNSLTPEDTAVYYCNTL
PWRANYSGQGTQVTVSS

>95B11, SEQ ID NO: 506; PRT; ->
EVQLVESGGGLVQPGGSLRLSCAASRSISSFNLLGWYRQAPGKQRELVA
HLLSGGSTVYPDSVKGRFTVSRDNTKNTVYLQMNSLKPEDTAVYYCNAIA
PALGSSWGQGTQVTVSS

>95F8, SEQ ID NO: 507; PRT; ->
EVQLVESGGGLVQAGGSLRLSCAASGIAFSIDIMDWYRQAPGKERELVAT
ISGGGSTNYADSVKGRFIVSRDNAKNILYLQMNSLKPDDTAVYYCNARRL
IYGRTVYWGQGTQVTVSS

TABLE B-7-continued

Preferred Nanobodies against B7-H2 (ICOSL)

\>95H8, SEQ ID NO: 508; PRT; ->
EVQLVESGGGLVQTGGSLRLSCAASSSTSTSSIDVMGWYRQSPGKQRIE
LVASISSFGSTYYADSVKGRFIISRDNAKNTVNLQMNNLKLEDTAVHFCN
LRRLSPPPLLDYWGQGTQVTVSS

\>95G5, SEQ ID NO: 509; PRT; ->
EVQLVESGGGLVQAGGSLRLSCASSSGTFSIDVMGWYRQAPGKVRERV
AIIGTGGFPVYADSVKGRFTISRDNAKNTVYLQMNSLKPEDTAVYYCNAA
RLVALGSWGQGTQVTVSS

\>95E6, SEQ ID NO: 510; PRT; ->
EVQLVESGGALVQPGGSLRLSCAASGFTLGDYVIGWFRQAPGKEREWV
SGISSRDDTTYYANSVKGRFTISRDNAKNTMYLQMNSLKPEDSAVYYCA
LRSGIAVARAPTNYDYWGQGTQVTVSS

\>95G6, SEQ ID NO: 511; PRT; ->
EVQLVESGGALVQPGGSLRLSCAASGFTLGDYVIGWFRQAPGKEREWV
SGISSRDGTTYYADSVKGRFTISRDNAKNTMYLQMNSLKPEDTAVYYC
ALRSGIAVARAPSNYDYWGQGTQVTVSS

TABLE B-8

Preferred Nanobodies against CD28

\>65C2, SEQ ID NO: 554; PRT; ->
EVQLVESGGGLVQAGCSLRLSCAASGLTFSNYVHGWFRQAPGKEREFVGT
ISWDCSDTYYTHSVKGRFTISRDNAKNVVNLQMNSLKPEDTAVYYCAADY
RPGGLLSLGKNEYDYWGQGTQVTVSS

\>70F9, SEQ ID NO: 555; PRT; ->
EVQLVESGGGLVQAGGSLRLSCAASGRTFSSYVMGWFRQAPGKEREFVA
AHSWYADYADSVKGRFSISRDNDKNTVYLQKNSLKPEDTAVYYCAASRS
QGRRYANSYESWGQGTQVTVSS

\>65B2, SEQ ID NO: 556; PRT; ->
EVQLVESGGGLVQAGGSLRLSCATSGRTFSSDVMGWFRQAPGKEREFV
AAINRSGHSTSYTGSVKGRFAISRDNTKNTVYLQMNSLKPEDTAVYYCAL
RLWSDYLAQKSGEYNYWGQGTQVTVSS

\>65C4, SEQ ID NO: 557; PRT; ->
EVQLVESGGGLVQAGGSLRLSCKAAGRTFSSYAMGWFRQAPGKEREFV
ASIEWDGGGAYYEEAVKGRFTISRDNTKNTVYLQMDSLRPEDTAVYYCAA
SRWRTALTNYYDVADWGQGTQVTVSS

\>65G2, SEQ ID NO: 558; PRT; ->
EVQLVESGGGLVQPGGSLRLSCAASGFTLDAYAIHWFRQAPGKEREGV
SCISSSDGSTYYANSVKGRFTISRDNAKNAVYLQMNSLKPEDTAVYYCAT
AKRCWGLSYEYDYWGQGTQVTVSS

\>70F10, SEQ ID NO: 559; PRT; ->
EVQLVESGGGLVQAGGSLRLSCAASGFTFDDYAIGWFRQAPGKEREGV
ACVSNSDGSTYYANSVKGRFTISSDNAKNTVYLQMNSLKPEDTAVYYCA
ADSRCWGWGMLHMRHGDRGQGTQVTVSS

TABLE B-9

Preferred Nanobodies against CTLA4

\>65H7, SEQ ID NO: 1288; PRT; ->
EVQLVESGGGLVQPGGSLRLSCAASGSILSIAVAGWYRRQPGKERELVATISPGNNTHYVDSVKGRFTISRDNAK
NTVYLQMTTLKPDDTAAYYCNAKGSILLNAFDYWGKGTQVTVSS

\>65D10, SEQ ID NO: 1289; PRT; ->
EVQLVESGGGLVQAGGSLRLSCAASGRTSSTATVGWFRQAPGKEREFVAVINWRSGFTYYADSVKGRFTISREYA
KNTVYLQMDSLKPEDTAVYSCAADLGGRTLYGGIHYSPEEYAYWGQGTQVTVSS

\>69A4, SEQ ID NO: 1290; PRT; ->
EVQLVESGGGLVQAGGSLRLSCAASGGTFSSYAMGWFRQAPGKEREFVAAISPSGLTSYKDSVVGRFTISRDNAK
NTVYLQMNSLKPEDTAVHYCAAGQWTWSPLRVSRLAEYNYWGQGTQVTVSS

\>66B5, SEQ ID NO: 1291; PRT; ->
EVQLVESGGGLVQPGESLRLSCAASKSIFSISVMAWYRQAPGKQRELVARITPGGNTNYVDSVQGRFTISRDNAK
NTVYLQMNSLKPEDTAVYYCNAQGSLLLAKYDYYGQGTQVTVSS

\>66B6, SEQ ID NO: 1292; PRT; ->
EVQLVESGGGLVQAGGSLRLSCAAPGRTFSNYAMGWFRQAPGKGREFVADIRWSDGRTYYADSVKGRFTVSRDNA
KNTVYLQMNSLKPEDTAVYYCAAQGGVLSGWDYWGQGTQVTVSS

\>66G2, SEQ ID NO: 1293; PRT; ->
EVQLVESGGGLVQPGGSLRLSCAASGFTLDYYAIGWFRQAPGKEREGVSCIDSSDGSTYYADSVKGRFTISRDNA
KNTVYLQMNSLKPEDTAVYYCAAVHGLKLPTLRGLGGSYYYLQARSYDYWGQGTQVTVSS

\>69D9, SEQ ID NO: 1294; PRT; ->
EVQLVESGGGLVQTGGSLRLSCAASGRTFSSYTMGWFRQAPGKDREFVAAISRSGSLTSYADSVKGRFTISRDNA
KKMAYLQMNSLKPEDTAVYYCAAAPVPWGTRPSLLTYDSWGQGTQVTVSS

\>65F9, SEQ ID NO: 1295; PRT; ->
EVQLVESGGGLVQAGGSLRLSCAASGRTLTTYIMGWFRQAPGKEREFVAATSPSGTLTSYADSVKGRFSMSRDNA
KKMVDLQMNSLKPEDTAVYYCAAKGGRWGPRNDDRYDYWGQGTQVTVSS

\>4CTLAPMP11E3, SEQ ID NO: 1296; PRT; ->
EVQLVESGGGLVEPGGSLRLSCAASGSISSYNVMGWYRQAPGQQRDLVAHIASNGEIMYADSAKGRFTISRDNAK
KTVYLQMNSLKPEDTAVYYCKLWVLGNDYWGQGTQVTVSS

\>4CTLAPMP12H2, SEQ ID NO: 1297; PRT; ->
EVQLVESGGGLVEPGGSLRLSCAASGSISSYNVMGWYRQAPGQQRDLVAHIASNGEIMYADSAKGRFTISRDNAK
KTVYLQMNSLKPEDTAVYYCKLWVLGNDYWGQRTQVTVSS

TABLE B-9-continued

Preferred Nanobodies against CTLA4

>4CTLAPMP33H10, SEQ ID NO: 1298; PRT; ->
EVQLVESGGGLVEPGGSLRLSCAASGSISSFNVMGWYRQAPGQQRDLVAHIASNGEIMYADSVKGRFTISRDNAK
KTVYLQMNSLKPEDTAVYYCKLWVLGNDYWGQGTQVTVSS

>4CTLAPMP29A4, SEQ ID NO: 1299; PRT; ->
EVQLVESGGGLVQTGGSLRLSCAASGSISSFNVMGWYRQAPGKQRDLVAHIASGGEIMYTDSVKGRFTISRDNAK
KTVYLQMNSLKPEDTAVYYCKLWVLGNDYWGQGTQVTVSS

>4CTLAPMP17C6, SEQ ID NO: 1300; PRT; ->
EVQLVESGGGLVQPGGSLRLSCAASGFTLDYYAIGWFRQAPGKEREGVSCIVGSDGSTYYADSVKGRFTISRDNA
KNTVYLQMNSLKPEDTAVYYCAAVHGLKLPTLRGLGGSYYYLQARSYDYWGQGTQVTVSS

>4CTLAPMP22D10CL7, SEQ ID NO: 1301; PRT; ->
EVQLVESGGGLVQPGGSLRLSCAASGFTLDYYAIGWFRQAPGKEREGVSCIDSSDGSTYYADSVKGRFTISRDNA
KNTVYLQMNSLKPEDTAVYYCAAVHGLKLPTLRGLGGSYYYLQARSYDYWGQGTQVTVSS

>4CTLAPMP32E2, SEQ ID NO: 1302; PRT; ->
EVQLVESGGGLVQPGGSLRLSCAASGFTLDYYAIGWFRQAPGKEREGVSCISLSDGSTYYADSVKGRFTISRDNA
KNTVYLQMNSLKPEDTAVYYCAAVHGLKLPTLRGLGGSYYYLQARSYDYWGQGTQVTVSS

>4CTLAPMP20F4CL8, SEQ ID NO: 1303; PRT; ->
EVQLVESGGGLVQPGGSLRLSCAASGFTLDYYAIGWFRQAPGKEREGVSCIVSSDGSTYYADSVKSRFTISRDNA
KNTVYLHMNSLKPEDTAVYYCAAVHGLKLPTLRGLGGSYYYLQARSYDYWGQGTQVTVSS

>4CTLAPMP29F7, SEQ ID NO: 1304; PRT; ->
EVQLVESGGGLVQPGGSLRLSCAASGFTLDYYAIGWFRQAPGKEREGVSCITISDGDTYYADSVKGRFTISRDNA
NNTVNLQMNSLKPEDTAVYYCAAVHGLKLPSQRGLGGSYYYLLPRSYDYWGQGTQVTVSS

>4CTLAPMP10C5, SEQ ID NO: 1305; PRT; ->
EVQLVESGGGLVQPGGSLRLSCAASGFTLDYYAIGWFRQAPGKEREGVSCITISDGDTYYADSVKGRFTIARDYA
KNTVYLQMNSLKPEDTAVYYCAAVHGLKLPSQRGLGGSYYYLLARSYDYWGQGTQVTVSS

>4CTLAPMP11F1, SEQ ID NO: 1306; PRT; ->
EVQLVESGGGLVQAGGSLRLSCAASGGTFSFYGMGWFRQAPGKEQEFVADIRTSAGRTYYADSVKGRFTISRDNA
KNTVYLQMNSLKPEDTAVYYCAAENSGISGWDYWGQGTQVTVSS

>4CTLAPMP29F2, SEQ ID NO: 1307; PRT; ->
EMQLVESGGGLVQAGGSLRLSCAASGGTFSFYGMGWFRQAPGKEQEFVADIRTSAGRTYYADSVKGRFTISRDNA
KNTVYLQMNSLKPEDTAVYYCAAEMSGISGWDYWGQGTQVTVSS

>4CTLAPMP03C4, SEQ ID NO: 1308; PRT; ->
EVQLVESGGGLVQAGGSLRLSCAASGGTFSFYGMGWFRQAPGKEREFVADIRTSAGRTYYADSVKGRFTISRDNA
KNTVYLQMNSLKPEDTAVYYCAAEMSGISGWDYWGQGTQVTVSS

>4CTLAPMP32F8, SEQ ID NO: 1309; PRT; ->
EVQLVESGGGLVQAGGSLRLSCAASGGTFSSYGMGWFRQAPGKEREFVADIRSSAGRTYYAGSVKGRFTISRDNA
KNTVYLQMNSLKPEDTAVYYCAAEMTGITGWDYWGQGTQVTVSS

>4CTLAPMP07F11, SEQ ID NO: 1310; PRT; ->
KVQLVESGGGLVQAGGSLRLSCAAPGRTFSNYAMGWFRQAPGKGREFVADIRWSDGRTYYADSVKGRFTVSRDNA
KNTVYLQMNSLKPEDTAVYYCAAQGGVLSGWDYWGQGTQVTVSS

>4CTLAPMP02C7, SEQ ID NO: 1311; PRT; ->
EVQLVESGGGLVQAGGSLRLSCAAPGRTFSNYAMGWFRQAPGKGREFVADIRWSDGRTYYADSVKGRFTVSRDNA
KNTVYLQMNSLKPEDTAVYYCAAQGGVLSGWDYWGQGTQVTVSS

>4CTLAPMP03A6, SEQ ID NO: 1312; PRT; ->
EVQLVESGGGLVQPGGSLRLSCAAPGRTFSNYAMGWFRQAPGKGREFVADIRWSDGRTYYADSVKGRFTVSRDNA
KNTVYLQMNSLKPEDTAVYYCAAQGGVLSGWDYWGQGTQVTVSS

>4CTLAPMP13B2, SEQ ID NO: 1313; PRT; ->
EVQLVESGGGLVQPGGSLRLSCVASGIHFAISTINWYRQAPGKQRESVAAITGTSVTGYADSVKGRFTLSRDNAK
NTVYLQMDNLKPEDTAVYYCNVWSGRDYWGQGTQVTVSS

>4CTLAPMP03G3, SEQ ID NO: 1314; PRT; ->
EVQLVESGGGLVQPAGSLRLSCADSGSIFSINTMGWYRQAPGKQRELVATITSSGTNYADSVKGRFTISRDNAK
NTVYLQMNSLKPEDTAVYYCNADYRDFGLSMERFIDFGSWGQGTQVTVSS

>4CTLAPMP16D7, SEQ ID NO: 1315; PRT; ->
EVQLVESGGGLVQPGGSLRLSCADAGSIFSINTMGWYRQAPGKQRELVAAITSGGSTNYADSVKGRFTISRDNAK
NTVYLQMNSLKPEDTAVYYCNADYRDFGLSMERFTDFGSWGQGTQVTVSS

TABLE B-9-continued

Preferred Nanobodies against CTLA4

>4CTLAPMP27D8, SEQ ID NO: 1316; PRT; ->
KVQLVESGGGLVQPGGSLRLSCAASGSDFSLNAMGWYRQAPGKQRELVAAITSGGSTNYADSVKGRFTISRDNAK
NTVYLQMNSLKPEDTAVYYCNADYRDFGLSMERFVDFGSWGQGTQVTVSS

>4CTLAPMP04B10, SEQ ID NO: 1317; PRT; ->
EMQLVESGGGLVQPGGSLRLSCAASGNIFSRYIMGWYRQAPGKQRELVADITPGGNTNYADSVKGRFTISRDGAK
NTVGLQMNSLRPEDTAVYSCYARGSDKLLMRTYWGQGTQVTVSS

>4CTLAPMP04B12, SEQ ID NO: 1318; PRT; ->
EVQLVESGGGLVQPGGSLRLSCAASGNIFSRYIMGWYRQAPGKERELVADITPGGNTNYANSVKGRFTISRDGAK
NTVGLQMNSLRPDDTAVYSCYARGSDKLLMRTYWGQGTQVTVSS

>4CTLAPMP06D2, SEQ ID NO: 1319; PRT; ->
EVQLVESGGGLVQPGGSLRLSCTASGNIFSRYIMGWYRQAPGKQRELVADITPGGNTNYADSVKGRFSISRDGAK
NTVDLQMNSLRPEDTAVYYCNALGSDKLLIRTYWGQGTQVTVSS

>4CTLAPMP03B1, SEQ ID NO: 1320; PRT; ->
EVQLVESGGGLVQPGGSLRLSCAASGNIFSRYIMGWYRQAPGKQRESVATITPGGNTDYADSVKGRFTISRDGAK
NTVDLQMNSLKPEDTAVYYCNARGSSGLSMSTYWGQGTQVTVSS

>4CTLAPMP03A7, SEQ ID NO: 1321; PRT; ->
EVQLVESGGGLVQPGGSLRLSCAASGNIFTRNVMGWYRQAPGKQRDLVASITPGGNIYYADSVKGRFTISRDGAK
NTVYLQMNSLKPEDTAVYYCNARGSILLDPINYWGQGTQVTVSS

>4CTLAPMP04A3, SEQ ID NO: 1322; PRT; ->
EVQLVESGGGLVQPGGSLRLSCAASGNIFTRNIMGWYRQAPGNQRDLVASITPGGNMYYADSVKGRFTISRDGAK
NTVYLQMNSLKPEDTAVYYCNARGSILLDPSNYWGQGTQVTVSS

>4CTLAPMP02A1, SEQ ID NO: 1323; PRT; ->
EVQLVESGGGLVQPGGSLRLSCAASGNIFTRNVMGWYRQAPGNQRDLVASITPGGNIYYADSVKGRFTISRDGAK
STVILQMNSLKPEDTAVYYCNARGSILLDRVNYWGQGTQVTVSS

>4CTLAPMP08E5, SEQ ID NO: 1324; PRT; ->
EVQLVESGGGLVQPGGSLRLSCAASRDIFTRNIMGWYRQAPGKQRDLVASITPGGNMYYADSVKGRFTISRDGAK
NTVYLQMNSLKPEDTAVYYCNAHGSILLDRSNYWGQGTQVTVSS

>4CTLAPMP03F7, SEQ ID NO: 1325; PRT; ->
EVQLVESGGGLVQPGGSLRLSCAASGNIFTRNIMGWYRQAPGKQRDLVASITPGGNINYADSVKGRFTISRDGAK
NTVYLQMNSLKPEDTAVYYCNAHGSILLNRSNYWGQGTQVTVSS

>4CTLAPMP02C11, SEQ ID NO: 1326; PRT; ->
EVQLVESGGGLVQPGGSLRLSCAASGNIFTRHIMGWYRQAPGKQRELVASITPGDNINYADSVKGRFTISRDGAK
NTVYLQMNSLKPEDTAVYYCNAHGSILLDRTNYWGQGTQVTVSS

>4CTLAPMP03B11, SEQ ID NO: 1327; PRT; ->
EVQLVESGGGLVQPGGSLRLSCAASGNIFTRNVMGWYRQAPGKQRDLVASITPGGNINYADSVKGRFTISRDGAK
NTVYLQMNSLKPEDTAVYYCNAHGSILLDRIEYWGQGTQVTVSS

>4CTLAPMP02H3, SEQ ID NO: 1328; PRT; ->
EVQLVESGGGLVQPGGSLRLSCAASGRTSSTATVGWFRQAPGKEREFVAVINWRSGFTYYADSVKGRFTISREYA
KNTVYLQMDSLKPEDTAVYSCAADLGGRTLFGGIHYSPEEYAYWGQGTQVTVSS

>4CTLAPMP17E3, SEQ ID NO: 1329; PRT; ->
EVQLMESGGGLVTAGGSLRLSCAASGGTFGHYAMAWFRRPPGNEREFVAGIGWTYTTFYADSVKGRFAISRDNAE
NTVYLQMNNLKPDDTAVYYCAAAELKGRNLRVPDYEHWGQCTQVTVSS

>4CTLAPMP10G5, SEQ ID NO: 1330; PRT; ->
EVQLVESGGGLVQAGGSLRLSCAASGGTFSRYIMAWFRQAPGKEREFVAVIDGSGYSTDYAGSVKGRFTIARDNT
KNTAYLQMNSLKPEDTALYFCGAGRQYSTGPYWYDYWGQGTQVTVSS

>4CTLAPMP02G3, SEQ ID NO: 1331; PRT; ->
EVQLVESGGGLVQTGGSLRLSCAASGRTFSNYTMGWFRQAPGKDREFVAAISRSGSLKSYADSVKGRFTISRDNA
KKMAYLQMLFLKLEDSAVYYCAAAPVPWGTRPSTFPYDSWGQGTQVTVSS

>4CTLAPMP25H11, SEQ ID NO: 1332; PRT; ->
EVQLVESGGGLVQTGGSLRLSCAASGRTFSNYTMGWFRQAPGKDREFVAAISRSGNLKSYADSVKGRFTISRDNA
KKMAYLQMNSLKLEDTAVYYCAAAPVPWGTRPSTFPYDSWGQGTQVTVSS

>4CTLAPMP10A11, SEQ ID NO: 1333; PRT; ->
EVQLMESGGGLVQTGGSLRLSCVASGRTFSNYTMGWFRQAPGKDREFVAAISRSGSLKSYADSVKGRFTISRDNA
KKMAYLQMLFLKLEDSAVYYCAAAPVPWGTRPSTFPYDSWGQGTQVTVSS

>4CTLAPMP02F6, SEQ ID NO: 1334; PRT; ->
EVQLVESGGGLVQTGGSLRLSCAASGRTFSNYTHGWFRQAPGKDREFVAAISRSGGLKSYADSVKGRFTISRDNA
KKMAYLQMNSLKLEDTAVYYCAAAPVPWGTRPSTFPYDSWGQGTQVTVSS

TABLE B-9-continued

Preferred Nanobodies against CTLA4

>4CTLAPMP02F4, SEQ ID NO: 1335; PRT; ->
EVQLVESGGGLVQTGGSLRLSCAASGRTFSNYTMGWFRQAPGKDREFVAAISRSGALKAYADSVKGRFTPSRDNA
KKMAYLQMNSLKPEDTAVYYCAAAPVPWGTRPSFFPYDSWGQGTQVTVSS

>4CTLAPMP17C1, SEQ ID NO: 1336; PRT; ->
EVQLVESGGGLVQTGGSLRLSCAASGRTFSNYTMGWFRQAPGKDREFVAAISRSGSLKAYADSVKGRFTPSRDNA
KKMAYLQMNSLKPEDTAVYYCAAAPVPWGTRPSLFPYDSWGQGTQVTVSS

>4CTLAPMP05E7, SEQ ID NO: 1337; PRT; ->
EVQLVESGGGLVQTGGSLRLSCAASGRTFSSYTMGWFRQAPGKDREFVTAISRSGTLTSYADSVKGRFTISRDNA
KKMAYLQMNSLKPEDTAVYYCAVAPVPWGTRPSLFPYDSWGQGTQVTVSS

>4CTLAPMP02F2, SEQ ID NO: 1338; PRT; ->
EVQLMESGGGLVQTGGSLRLSCAASGRTFSNYTMGWFRQAPGKDREFVAAISRSGSLKAYADSVKGRFTPSRDNA
KKMAYLQMNSLKPEDTAVYYCAAAPVPWGTRPSLFPYDSWGQGTQVTVSS

>4CTLAPMP10F8, SEQ ID NO: 1339; PRT; ->
EVQLVESGGGLVQTGGSLRLSCAASGRTFSNYTMGWFRQAPGKDREFVAAISRSGSLKSYADSVNGRFTISRDNA
KKMAYLQMNSLKPEDTASYYCAAAPVPWGTRPSFLTYDSWGQGTQVTVSS

>4CTLAPMP02F8, SEQ ID NO: 1340; PRT; ->
EVQLVESGGGLVQTGGSLRLSCAASGRTFSNYTMGWFRQAPGKDREFVAAISRSGNLKSYADSVNGRFTISRDNA
KKMAYLQMNSLKPEDTAVYYCAAAPVPWGTRPSFLTYDSWGQGTQVTVSS

>4CTLAPMP02E2, SEQ ID NO: 1341; PRT; ->
AVQLVESGGGLVQTGGSLRLSCAASGRTFSSYTMGWFRQAPGKDREYVAAISRSGSLKGYADSVKGRFTISRDNA
KNMAYLQMNSLKPEDTAVYYCAAAPVPWGTRPSLLTYDSWGQGTQVTVSS

>4CTLAPMP33D9, SEQ ID NO: 1342; PRT; ->
EVQLVESGGGLVQTGGSLRLSCAASGRTFSSYTMGWFRQAPGKDREYVAAISRSGSLKGYADLSVKGRFTISRDNA
KNMAYLQMNSLKPEDTAVYYCAAAPVPWGTRPSLLTYDSWGQGTQVTVSS

>4CTLAPMP27C8, SEQ ID NO: 1343; PRT; ->
EVQLVESGGGLVQTGGSLRLSCAASGRTFSNYTMGWFRQAPGKDREFVAAISRSGTLKAYADSVKGRFTISRDNA
KKMAYLQMNSLKPEDTAVYYCAAAPVPWGTRPSFFTYDSWGQGTQVTVSS

>4CTLAPMP17D5, SEQ ID NO: 1344; PRT; ->
EVQLVESGGGLVQTGGSLRLSCAASGRTFSSYTTGWFRQAPGKDREFVAAISRSGSLTSYADSVKGRFTISRDNA
KKMAYLQMNSLKPEDAAVYYCAAAPVPWGTRPSFFTYDSWGQGTQVTVSS

>4CTLAPMP02H7, SEQ ID NO: 1345; PRT; ->
EVQLVESGGGLVQTGGSLRLSCAASGRTFSNYTMGWFRQAPGKDREFVAAISRSGSLKAYADSVKGRFTISRDNA
KKMAYLQMNSLKPEDTAVYYCAAAPVPWGTRPSFFTYDSWGQGTQVTVSS

>4CTLAPMP02G2, SEQ ID NO: 1346; PRT; ->
EVQLVESRGGLVQTGGSLRLSCAASGRTFSNYTMGWFRQAPGKDREFVAAISRSGSLKSYADSVKGRFTISRDNA
KKMAYLQMNSLKPEDTAVYYCAAAPVPWGTRPSFFTYDSWGQGTQVTVSS

>4CTLAPMP10D5, SEQ ID NO: 1347; PRT; ->
EVQLVESGGGVVQTGGSLRLSCAASGRTFSMYTMGWFRRAPGKDREFVAAISRSGGLKAYADSVLGRFTISRDNA
NEMAYLQMNSLNPEDTAVYYCAAAPVPWGTRPSHFTYDSWGQGTQVTVSS

>4CTLAPMP10G9, SEQ ID NO: 1348; PRT; ->
EVQLVESGGGVVQTGGSLRLSCAASGRTFSMYTMGWFRQAPGEDREFVAAISRSGGLKAYADSVLGRFTISRDNA
NEMAYLQMNSLNPEDTAVYYCAAAPVPWGTRPSHFTYDSWGQGTQVTVSS

>4CTLAPMP05G9, SEQ ID NO: 1349; PRT; ->
EVQLVESGGGVVQTGGSLRLSCAASGRTFSMYTMGWFRQAPGKDREFVAAISRSGGLKAYADSVLGRFTISRDNA
NEMAYLQMNSLNPEDTAVYYCAAAPVPWGTRPSHFTYDSWGQGTQVTVSS

>4CTLAPMP10B7, SEQ ID NO: 1350; PRT; ->
EVQLVESRGGLVQPGGSLRLSCAASGRAFNNYTMGWFRQAPGKDREFVAAISRSGNLKAYADSVNGRFTISRDNA
KKMAYLQMNSLKPEDTSVYYCTAAPVPWGTRPSLFTYDSWGQGTQVTVSS

>4CTLAPMP29B10, SEQ ID NO: 1351; PRT; ->
EVQPVESGGGLVQTGGSLRLSCAASGRTFSNYTMGWFRQAPGKDREFVAAISRSGNLKAYADSVKGRFTISRDNA
KKMAYLQMNSLKPEDTAVYYCAAAPVPWGTRPSLFTYDSWGQGTQVTVSS

>4CTLAPMP24E3, SEQ ID NO: 1352; PRT; ->
EVQLVESGGGLVQTGGSLRLSCAASGRAFNNYTMGWFRQAPGKDREFVAAISRSGNLKAYADSVNGRFTISRDNA
KEMAYLQMNSLKPEDTSVYYCTAAPVPWGTRPSLFTYDSWGQGTQVTVSS

>4CTLAPMP10F4, SEQ ID NO: 1353; PRT; ->
EVQLVESGGGLVQTGGSLRLSCAASGRAFNNYTMGWFRQAPGKDREFVAAISRSGNLKAYADSVNGRFTTSRDNA
KKMAYLQMNSLKPEDTSVYYCTAAPVPWGTRPSLFTYDSWGQGTQVTVSS

TABLE B-9-continued

Preferred Nanobodies against CTLA4

>4CTLAPMP10F11, SEQ ID NO: 1354; PRT; ->
EVQLVESGGGLVQTGGSLRLSCAASGRTFSSYTMGWFRQAPGKDREFVAAISRSGGLTSYADSVKGRFTISRDNG
KKMAYLQMNSLKPEDTAVYYCAAAPVPWGTRPSLFTYDSWGQGTQVTVSS

>4CTLAPMP32B8, SEQ ID NO: 1355; PRT; ->
EVQLVESGGGLVQTGGSLRLSCAASGRAFNNYTMGWFRQAPGKDREFVAAISRSGNLKAYADSVNGRFTISRDNA
KKMAYLQMNSLKPEDTSVYYCTAAPVPWGTRPSLFTYDSWGQGTQVTVSS

>4CTLAPMP10G11, SEQ ID NO: 1356; PRT; ->
EVQLVESGGDLVQPGGSLRLSCAASGRTFSNYTVGWFRQAPGKDREFVTAISRSGSLKAYADSVKDRFTISRDNA
KKMAYLQMNSLKPEDTAVYYCAGAPVPWGARPSLFTYDSWGQGTQVTVSS

>4CTLAPMP10B9, SEQ ID NO: 1357; PRT; ->
EVQLVESGGGLVQTGGSLRLSCAASGRTFSNYTVGWFRQAPGKDREFVTAISRSGSLKAYADSVKDRFTISRDNA
KKMAYLQMNSLKPEDTAVYYCAGAPVPWGARPSLFTYDSWGQGTQVTVSS

>4CTLAPMP05G2, SEQ ID NO: 1358; PRT; ->
EVQLVESGGELVQAGDSLRLSCAASGRTFSSYIMGWFRQAPGKEREFVAAISPSGALTSYADSVKGRFTISRDNA
EKMVYLQMSSLKPEDTDVYYCAAARVPWSPRPSLSPYDYWGQGTQVTVSS

>4CTLAPMP17H5, SEQ ID NO: 1359; PRT; ->
EVQLVESGGELVQAGDSLRLSCAASGRTFSSYIMGWFRQAPGKEREFVAAISPSGALTSYADSVKGRFTISRDNA
EKMVYLQMSSLKPEDTDAYYCAAARVPWSPRPSLSPYDYWGQGTQVTVSS

>4CTLAPMP05E10, SEQ ID NO: 1360; PRT; ->
EVQLVESGGGLVQAGDSLRLSCAASGRTFSSYIMGWFRQAPGKEREFVAAISSSGALTSYADSVKGRFTISRDNA
EKMVYLQMSSLKPEDTDVYYCAAARVPWSPRPSLSTYDYWGQGTQVTVSS

>4CTLAPMP05E11, SEQ ID NO: 1361; PRT; ->
EVQLVESGGGLVQAGDSLRLSCAASGRTFSSYIMGWFRRAPGKEREFVAAISSSGALTSYADSVVGRFTISRDNA
KKMVYLQMRSLKPEDTDVYYCAAARVPWSPRPSLSTYDYWGQGTQVTVSS

>4CTLAPMP05E4, SEQ ID NO: 1362; PRT; ->
EVQLVESGGGLVQAGDSLTLSCAASGGTFSTYVMGWFRQASGKEREFVAAISPSGTLTSYADSVKGRFGISRDNA
KKMVYLQVSSLKPEDTDVYYCAAARGPWTPRPSLLTYDYWGQGTQVTVSS

>4CTLAPMP17F6, SEQ ID NO: 1363; PRT; ->
EVQLVESGGGLVQAGDSLRLSCAASGRTFSSYVMGWFRQAPGKEREFVAAISSSGALTSYADSVYGRFTISRDNA
KKMVYLQMSSLKPEDTDVYYCAAGRGPWSPRPSLLTYDYWGQGTQVTVSS

>4CTLAPMP10E11, SEQ ID NO: 1364; PRT; ->
EVQLVESGGGLVQAGDSLRLSCAASGRTFSNYVMGWFRQAPGKEREFVSAISPSGTLTSYTDSVKGRFAISRDNA
KKMLYLQMSSLKPEDTDVYYCAAARGPWSARPSLLTYDYWGQGTQVTVSS

>4CTLAPMP17C5, SEQ ID NO: 1365; PRT; ->
EVQLVESGGGLVQAGDSLRLSCAASGRTFSSYVMGWFRQAPGKEREFVAAISPSGSLTSYADSVKGRFAISRDNA
KVMVYLQMSSLKPDDTDVYYCAAARGPWNARPSLLTYDYWGQGTQVTVSS

>4CTLAPMP11D1, SEQ ID NO: 1366; PRT; ->
EVQLVESGGGLVQAGGSLSLSCAASGRTFSSITMAWFRQTPGKEREFVAAISRSGSLTSYADSLKGRFTISRDNA
KNTVSLQMNNLKPEDTAVYYCAADTNGRWRPAIRPSDFEIWGQGTQVTVSS

>4CTLAPMP17C3, SEQ ID NO: 1367; PRT; ->
EVQLVESGGGLVQAGGSLGLSCAASGRSFSMYAMGWFRTAPGKEREFVAAISGSGTLTSYADSVKGRFAISRDNA
KNTVYLRMNNLNAEDTAVYYCAARSGWGAAMRSADFRSWGQGTQVTVSS

>4CTLAPMP10A1, SEQ ID NO: 1368; PRT; ->
EVQLVESGGQLVQAGGSLRLSCAATGRTYNSYSLGWSRQAPGKEREFVAAISASGTLRAYADSVKGRFTISRDNA
KNTVYLQMNNLKPEDTAVYYCGRHRSVGWRASHHLSDYDNWGQGTQVTVSS

>4CTLAPMP31A8, SEQ ID NO: 1369; PRT; ->
EVQLVESGGQLVQAGDSLRLSCVATGRTYNSYSLGWSRQAPGKEREFVAAISASGTLRAYADSVKGRFTISRDNA
KNTVYLQRMNNLKPDDTAVYYCGRHRSVGWRASHHLSDYDNWGQGTQVTVSS

>4CTLAPMP02H5, SEQ ID NO: 1370; PRT; ->
EVQLVESGGQLVQAGGSLRLSCAATGRTYNSYSLGWSRQAPGKEREFVAAISASGTLRAYADSVKGRFTISRDNA
KNTVYLQMNSLKPEDTAVYYCGRHRSVGWRASHHLSDYDNWGQGTQVTVSS

>4CTLAPMP10G3, SEQ ID NO: 1371; PRT; ->
EVQLVESGGQLVQAGGSLRLSCTATGHTYNTYPLGWFRQAPGKEREFVAAISPSGTLRAYADSVKGRFTISRDNA
KNTWLQMNNLKPEDTAVYYCARHRSVGWRASHHLSDYDNWGQGTQVTVSS

>4CTLAPMP05F10, SEQ ID NO: 1372; PRT; ->
EVQLVESGGQLVQAGGSLRLSCAATGRMYNSYSLGWSRQAPGKEREFVAAISASGTLRAYADSVKGRFTISRDNA
KNTVYLQMNNLKPEDTAVYYCGRHRSVGWRASHHLSDYDNWGQGTQVTVSS

TABLE B-9-continued

Preferred Nanobodies against CTLA4

>4CTLAPMP10B8, SEQ ID NO: 1373; PRT; ->
EVQLVESGGQLVQAGGSLRLSCAATGHTYNTYPLGWFRQAPGKEREFVAAISPSGTLRAYAFLSVKGRFTISRDNA
KNTWLQMNNLKPEDTAVYYCARHRSVGWRASHHLSDYDNWGQGTQVTVSS

>4CTLAPMP05H11, SEQ ID NO: 1374; PRT; ->
EVQLVESGGQLVQAGGSLRLSCAATGRTYNSYPLGWFRQAPGKEREFVAAISASGTLRAYADSVKGRFTISRDNA
KNTVCLQMNNLKPEDTAVYYCAQHRSVGWRASHHLSDYDNWGQGTQVTVSS

>4CTLAPMP17H9, SEQ ID NO: 1375; PRT; ->
EVQLVESGGQLVQAGGSLRLSCAATGRTYNSYSLGWFRQAPGKEHEFVAAISASGTLRAYADSVKGRFTISRDNA
KNTVYLQMNNLKPEDTAVYYCARHHSVGWRASHHLSDYDNWGQGTQVTVSS

>4CTLAPMP2G9, SEQ ID NO: 1376; PRT; ->
EVQLVKSGGQLVQAGGSLRLSCAATGRTYNSYPLGWFRQAPGKEREFVAAISASGTLRAYADSVKGRFTISRDSA
KNTVYLQMNNLKPEDTAVYYCARARSVGWRASHHLSDYDNWGQGTQVTVSS

>4CTLAPMP10H5, SEQ ID NO: 1377; PRT; ->
EVQLVESGGQLVQAGGSLRLSCTATGHTFNTYPLAWFRQAPWKEREFVAAISPSGTLRAYADSVKGRFTISRGNA
KNTVYLQMNNLKPEDTAVYYCARDRSVGWRASHHLSDYGNWGQGTQVTVSS

>4CTLAPMP10B5, SEQ ID NO: 1378; PRT; ->
EVQLVESGGQLVQAGGSLRLSCAATGRTYNSYPLGWFRQAPGKEREFVAAISASGTLRAYADSVKGRFTISRDNA
KNTVYLQMNNLKPEDTAVYYCARDRSVGWRASHHLSDFDTWGQGTQVTVSS

>4CTLAPMP02A2, SEQ ID NO: 1379; PRT; ->
EVQLVESGGGLVQAGGSLRLSCAASGRTFSNTLMGWSRRAPGKEREFVAAISGSGTLTSYADSVKGRFAISRDNA
NDTVYLQMNSLKPEDTAIYYCAAGLTGWAVIPSRTLTTWGQGTQVTVSS

>4CTLAPMP02B8, SEQ ID NO: 1380; PRT; ->
EVQLVESGGGLVQAGGSLRLSCAASGRTFSNTLMGWSRRAPGKEREFVAAISGSGTLTSYADLSVKGRFAISRBNA
NDTVYLQMNSLKPEDTAIYYCAAGLTGWAVIPSRTLTTWGQGTQVTVSS

>4CTLAPMP02A5, SEQ ID NO: 1381; PRT; ->
EVQLVESGGGLVQAGGSLRLSCAASGRTNSTTLMGWSRRAPGKEREFVAAISGSGTLTSYADSVKGRFAISRDNA
KNTVYLQMNSLKPEDTAIYYCAAGLTSWALIPSRTLTTWGQGTQVTVSS

>4CTLAPMP02B11, SEQ ID NO: 1382; PRT; ->
EVQLVESGGGLVQAGGSLRLSCAAPGRTNSTTLMGWSRRAPGKEREFVAAISGSGTLTSYADSVKGRFAISRDNA
KNTVYLQMNSLKPEDTAIYYCAAGLTSWALIPSRTLTTWGQGTQVTVSS

>4CTLAPMP09C1, SEQ ID NO: 1383; PRT; ->
EVQLVESGGGLVQPGGSLRLSCAASGRTNSTTLMGWSRRAPGKEREFVAAISGSGTLTSYADSVKGRFAISRDNA
KNTVYLQMNSLKPEDTAIYYCAAGLTSWALIPSRTLTTWGQGTQVTVSS

>4CTLAPMP05C5, SEQ ID NO: 1384; PRT; ->
EVQLVESGGGLVQAGGSLRLSCAASGRMFSSRSIGWFRQVPGKEREFVAAISPSRSLKAYADSVKGRFTISGDNA
KNTVDLQMNSLNVEDMAVYYCAADVISGRWYGGAFTPSRFDYWGQGTQVTVSS

>4CTLAPMP12B2, SEQ ID NO: 1385; PRT; ->
EVQLVESGGGLVQAGGSLALSCAASGRMFSSRSIGWFRQAPGKDREFVAAISPSGSLKAYADSVKGRFTISRDNA
KNTVDLQMNSLNTEDMAVYYCAADVISGRWYAGAFTPSRFDYWGQGTQVTVSS

>4CTLAPMP17B5, SEQ ID NO: 1386; PRT; ->
EVQLVESGGGLVQAGGSLRLSCAASGRTLTTYIMGWFRQAPGKEREFVAATSPSGTLTSYADSVKGRFSMSRDNA
KKMVDLQMNSLKPEDTAVYYCAAKGGRWGPRNDDRYDYWGQGTQVTVSS

>4CTLAPMP02B10, SEQ ID NO: 1387; PRT; ->
EVQLVESEGGLVQPGGSLRLSCSASGRTFANNAMGWFRQAPGKEREFVASISASGTLTSSADSVKGRFTISRDNA
KNTVYLQMNSLKPEDTALYYCARNRRAWSLSVHTTREYDDWGQCTQVTVSS

>4CTLAPMP02C9, SEQ ID NO: 1388; PRT; ->
KVQLVESGGGLVQAGGSLRLSCSASGRTFANNAMGWFRQAPGKEREFVASLSASGSLTSYADSVNGRFTISRDNA
KNTVYLQMNSLKPVDTALYYCARNRRAWSLSVHTTREYDDWGQGTQVTVSS

>4CTLAPMP04G10, SEQ ID NO: 1389; PRT; ->
EVQLVESGGGLVKAGDSLRLSCSASGRTFANNAMGWFRQAPGKEREFVASISASGTLTSSADSVRGRFTISRDNA
KNTVYLQMNSLKPEDTALYYCARNRRAWSLSVHTTREYDDWGQGTQVTVSS

>4CTLAPMP17B6, SEQ ID NO: 1390; PRT; ->
EVQLVESGGGLVQAGGSLRLSCVASAEGSFSTYVMAWFRQAPGKEREFAAAISGRSGLTSYADSVKGRFTISRDN
AKNTVYLQMNSLKPEDAARYYCAADRRAWSARPDMGNYYWGQGTQVTVSS

>4CTLAPMP06C10, SEQ ID NO: 1391; PRT; ->
EVQLVESGGGLVQAGGSLRLSCAASGRTFSNYTIAYFRQAPGREREFAAAISPHGTLRSFADSVKDRFTISRDNA
KNTVWLQMNSLKLEDTAVYYCAADPSGWGLRQHSENEYPYWGLGTQVTVSS

TABLE B-10

Multivalent CTLA4 binding Nanobodies

>11F1-9GS-11F1-9GS-ALB1, SEQ ID NO: 1392; PRT; ->
EVQLVESGGGLVQAGGSLRLSCAASGGTFSFYGMGWFRQAPGKEQEFVADIRTSAGRTYYADSVKGRFTISRDNA
KNTVYLQMNSLKPEDTAVYYCAAEMSGISGWDYWGQGTQVTVSSGGGGSGGGSEVQLVESGGGLVQAGGSLRLSC
AASGGTFSFYGMGWFRQAPGKEQEFVADIRTSAGRTYYADSVKGRFTISRDNAKNTVYLQMNSLKPEDTAVYYCA
AEMSGISGWDYWGQGTQVTVSSGGGGSGGGSEVQLVESGGGLVQPGNSLRLSCAASGFTFRSFGMSWVRQAPGKE
PEWVSSISGSGSDTLYADSVKGRFTISRDNAKTTLYLQMNSLKPEDTAVYYCTIGGSLSRSSQGTQVTVSS

>12H2-9GS-12H2-9GS-ALB1, SEQ ID NO: 1393; PRT; ->
EVQLVESGGGLVEPGGSLRLSCAASGSISSYNVMGWYRQAPGQQRDLVAHIASNGEIMYADSAKGRFTISRDNAK
KTVYLQMNSLKPEDTAVYYCKLWVLGNDYWGQETQVTVSSGGGGSGGGSEVQLVESGGGLVEPGGSLRLSCAASG
SISSYNVMGWYRQAPGQQRDLVAHIASNGEIMYADSAKGRFTISRDNAKKTVYLQMNSLKPEDTAVYYCKLWVLG
NDYWGQETQVTVSSGGGGSGGGSEVQLVESGGGLVQPGNSLRLSCAASGFTFRSFGMSWVRQAPGKEPEWVSSIS
GSGSDTLYADSVKCRFTISRDNAKTTLYLQMNSLKPEDTAVYYCTIGGSLSRSSQGTQVTVSS

>2F4-9GS-2F4-9GS-ALB1, SEQ ID NO: 1394; PRT; ->
EVQLVESGGGLVQTGGSLRLSCAASGRTFSNYTMGWFRQAPGKDREFVAAISRSGALKAYADSVKGRFTPSRDNA
KKMAYLQMNSLKPEDTAVYYCAAAPVPWGTRPSFFPYDSWGQGTQVTVSSGGGGSGGGSEVQLVESGGGLVQTGG
SLRLSCAASGRTFSNYTMGWFRQAPGKDREFVAAISRSGALKAYADSVKGRFTPSRDNAKKMAYLQMNSLKPEDT
AVYYCAAAPVPWGTRPSFFPYDSWGQGTQVTVSSGGGGSGGGSEVQLVESGGGLVQPGMSLRLSCAASGFTFRSF
GMSWVRQAPGKEPEWVSSISGSGSDTLYADSVKGRFTISRDNAKTTLYLQMNSLKPEDTAVYYCTIGGSLSRSSQ
GTQVTVSS

>2G9-9GS-2G9-9GS-ALB1, SEQ ID NO: 1395; PRT; ->
EVQLVKSGGQLVQAGGSLRLSCAATGRTYNSYPLGWFRQAPGKEREFVAAISASGTLRAYADSVKGRFTISRDSA
KNTVYLQMNNLKPEDTAVYYCARARSVGWRASHHLSDYDNWGQGTQVTVSSGGGGSGGGSEVQLVKSGGQLVQAG
GSLRLSCAATGRTYNSYPLGWFRQAPGKEREFVAAISASGTLRAYADSVKGRFTISRDSAKNTVYLQMNNLKPED
TAVYYCARARSVGWRASHHLSDYDNWGQGTQVTVSSGGGGSGGGSEVQLVESGGGLVQPGNSLRLSCAASGFTFR
SFGMSWVRQAPGKEPEWVSSISGSGSDTLYADSVKGRFTISRDNAKTTLYLQMNSLKPEDTAVYYCTIGGSLSRS
SQGTQVTVSS

>11F1-9GS-11F1-GGGC, SEQ ID NO: 1396; PRT; ->
EVQLVESGGGLVQAGGSLRLSCAASGGTFSFYGMGWFRQAPGKEQEFVADIRTSAGRTYYADSVKGRFTISRDNA
KNTVYLQMNSLKPEDTAVYYCAAEMSGISGWDYWGQGTQVTVSSGGGGSGGGSEVQLVESGGGLVQAGGSLRLSC
AASGGTFSFYGMGWFRQAPGKEQEFVADIRTSAGRTYYADSVKGRFTISRDNAKNTVYLQMNSLKPEDTAVYYCA
AEMSGISGWDYWGQGTQVTVSSGGGC

>12H2-9GS-12H2-GGGC, SEQ ID NO: 1397; PRT; ->
EVQLVESGGGLVEPGGSLRLSCAASGSISSYNVMGWYRQAPGQQRDLVAHIASNGEIMYADSAKGRFTISRDNAK
KTVYLQMNSLKPEDTAVYYCKLWVLGNDYWGQETQVTVSSGGGGSGGGSEVQLVESGGGLVEPGGSLRLSCAASG
SISSYNVMGWYRQAPGQQRDLVAHIASNGEIMYADSAKGRFTISRDNAKKTVYLQMNSLKPEDTAVYYCKLWVLG
NDYWGQETQVTVSSGGGC

>11F1-9GS-11F1-HSA, SEQ ID NO: 1398; PRT; ->
EVQLVESGGGLVQAGGSLRLSCAASGGTFSFYGMGWFRQAPGKEQEFVADIRTSAGRTYYADSVKGRFTISRDNA
KNTVYLQMNSLKPEDTAVYYCAAEMSGISGWDYWGQGTQVTVSSGGGGSGGGSEVQLVESGGGLVQAGGSLRLSC
AASGGTFSFYGMGWFRQAPGKEQEFVADIRTSAGRTYYADSVKGRFTISRDNAKNTVYLQMNSLKPEDTAVYYCA
AEMSGISGWDYWGQGTQVTVSSDAHKSEVAHRFKDLGEENFKALVLIAFAQYLQQCPFEDHVKLVNEVTEFAKTC
VADESAENCDKSLHTLFGDKLCTVATLRETYGEMADCCAKQEPERNECFLQHKDDNPNLPRLVRPEVDVMCTAFH
DNEETFLKKYLYEIARRHPYFYAPELLFFAKRYKAAFTECCQAADKAACLLPKLDELRDEGKASSAKQRLKCASL
QKFGERAFKAWAVARLSQRFPKAEFAEVSKLVTDLTKVHTECCHGDLLECADDRADLAKYICENQDSISSKLKEC
CEKPLLEKSHCIAEVENDEMPADLPSLAADFVESKDVCKNYAEAKDVFLGMFLYEYARRHPDYSVVLLLRLAKTY
ETTLEKCCAAADPHECYAKVFDEFKPLVEEPQNLIKQNCELFEQLGEYKFQNALLVRYTKKVPQVSTPTLVEVSR
NLGKVGSKCCKHPEAKRMPCAEDYLSVVLNQLCVLHEKTPVSDRVTKCCTESLVNRRPCFSALEVDETYVPKEFN
AETFTFHADICTLSEKERQIKKQTALVELVKHKPKATKEQLKAVMDDFAAFVEKCCKADDKETCFAEEGKKLVAA
SQAALGL

>12H2-9GS-12H2-HSA, SEQ ID NO: 1399; PRT; ->
EVQLVESGGGLVEPGGSLRLSCAASGSISSYNVMGWYRQAPGQQRDLVAHIASNGEIMYADSAKGRFTISRDNAK
KTVYLQMNSLKPEDTAVYYCKLWVLGNDYWGQETQVTVSSGGGGSGGGSEVQLVESGGGLVEPGGSLRLSCAASG
SISSYNVMGWYRQAPGQQRDLVAHIASNGEIMYADSAKGRFTISRDNAKKTVYLQMNSLKPEDTAVYYCKLWVLG
NDYWGQETQVTVSSDAHKSEVAHRFKDLGEENFKALVLIAFAQYLQQCPFEDHVKLVNEVTEFAKTCVADESAEN
CDKSLHTLFGDKLCTVATLRETYGEMADCCAKQEPERNECFLQHKDDNPNLPRLVRPEVDVMCTAFHDNEETFLK
KYLYEIARRHPYFYAPELLFFAKRYKAAFTECCQAADKAACLLPKLDELRDEGKASSAKQRLKCASLQKFGERAF
KAWAVARLSQRFPKAEFAEVSKLVTDLTKVHTECCHGDLLECADDRADLAKYICEMQDSISSKLKECCEKPLLEK
SHCIAEVENDEMPADLPSLAADFVESKDVCKNYAEAKDVFLGMFLYEYARRHPDYSVVLLLRLAKTYETTLEKCC
AAADPHECYAKVFDEFKPLVEEPQNLIKQNCELFEQLGEYKFQNALLVRYTKKVPQVSTPTLVEVSRNLGKVGSK
CCKHPEAKRMPCAEDYLSVVLNQLCVLHEKTPVSDRVTKCCTESLVNRRPCFSALEVDETYVPKEFNAETFTFHA
DICTLSEKERQIKKQTALVELVKHKPKATKEQLKAVMDDFAAFVEKCCKADDKETCFAEEGKKLVAASQAALGL

TABLE C-1

Immunization protocol with CD80-Fc and CD86-Fc

| Day | Llama 089 | Llama 090 | Tissue collection |
|---|---|---|---|
| 0 | 100 µg | 100 µg | 10 ml pre-immune blood |
| 7 | 20 µg | 20 µg | — |
| 14 | 50 µg | 50 µg | — |
| 20 | 10 µg | 10 µg | — |
| 28 | 50 µg | 50 µg | — |
| 35 | 10 µg | 10 µg | — |
| 39 | | | 150 ml immune blood (PBL1) lymph node bow biopsy |
| 43 | | | 150 ml immune blood (PBL2) |

TABLE C-2

Size and percentages of inserts of constructed libraries

| | Library size | % insert |
|---|---|---|
| Llama No. 089 | 6E7 | 96% |
| Llama No. 090 | 6E7 | 96% |

TABLE C-3

Experimental conditions used in different selection strategies

| Method 1 | Antigen 1 | Elution 1 | Method 2 | Antigen 2 | Elution 2 |
|---|---|---|---|---|---|
| Passive plate immobilization | HuCD80-HuIgG1 at 2 µg/ml | Trypsin | Passive plate immobilization | HuCD80-HuIgG1 at 2 µg/ml | Trypsin |
| Passive plate immobilization | HuCD86-HuIgG1 at 2 µg/ml | Trypsin | Passive plate immobilization | HuCD86-HuIgG1 at 2 µg/ml | Trypsin |
| Passive plate immobilization | HuCD80-HuIgG1 at 2 µg/ml | Trypsin | Passive plate immobilization | HuCD86-HuIgG1 at 2 µg/ml | Trypsin |
| Passive plate immobilization | HuCD86-HuIgG1 at 2 µg/ml | Trypsin | Passive plate immobilization | HuCD80-HuIgG1 at 2 µg/ml | Trypsin |

TABLE C-4

ELISA and FACS data of representative CD80 and/CD86 binding clones

| Libs No. 089/090 | CD80-IgG1 | CD86-IgG1 | IgG1 | BLANK | FACS |
|---|---|---|---|---|---|
| PMP1A3 | 1.916 | 0.053 | 0.052 | 0.052 | ++ |
| PMP1B2 | 1.985 | 0.038 | 0.046 | 0.041 | ++ |
| PMP1D1 | 1.892 | 0.043 | 0.046 | 0.044 | ++ |
| PMP2A7 | 1.714 | 0.042 | 0.043 | 0.039 | ++ |
| PMP1H5 | 0.061 | 1.458 | 0.054 | 0.054 | + |
| PMP2B10 | 0.042 | 1.725 | 0.044 | 0.042 | + |
| PMP2D2 | 0.055 | 1.511 | 0.039 | 0.041 | + |
| PMP2H7 | 0.049 | 1.521 | 0.045 | 0.050 | + |
| PMP2E6 | 1.519 | 0.538 | 0.049 | 0.049 | + |
| PMP2F5 | 1.652 | 0.774 | 0.056 | 0.051 | + |

TABLE C-5

Expression yields of anti-CD80/CD86 mono- and bireactive Nanobodies in *E. coli*

| Clone | Volume (l) | yield (mg) | yield (mg/l) |
|---|---|---|---|
| PMP1B2 | 0.200 | 0.554 | 2.72 |
| PMP1C7 | 0.200 | 1.450 | 7.25 |
| PMP1E11 | 0.200 | 1.700 | 8.50 |
| PMP2B4 | 0.200 | 0.464 | 2.32 |

TABLE C-6

Screening for Nanobodies that inhibit the CD80 and/or CD86 interaction with CD28 or CTLA4

| | HuCD28-HuIgG1 | | CD80/ CD86 FACS | HuCTLA4-HuIgG1 | | CD80/CD86 FACS |
|---|---|---|---|---|---|---|
| Clone | CD80 ELISA | CD86 ELISA | | CD80 ELISA | CD86 ELISA | |
| PMP1B2 | − | − | − | − | − | − |
| PMP2B10 | + | − | − | + | − | − |
| PMP1C7 | +++ | − | ++ | +++ | − | ++ |
| PMP1E11 | ++ | ++ | + | + | ++ | + |
| PMP2B4 | + | + | − | − | − | − |

TABLE C-7

Affinity constants of Nanobodies that bind CD80-Ig and/or CD86-Ig

| | CD80-Ig | | | CD86-Ig | | |
|---|---|---|---|---|---|---|
| Clone | $k_{on}$ (1/Ms) | $k_{off}$ (1/s) | $K_d$ (nM) | $k_{on}$ (1/Ms) | $k_{off}$ (1/s) | $K_d$ (nM) |
| PMP1C7 | 3.5E5 | 3.7E−4 | 1.1 | 3.3E3 | 2.7E−3 | 825 |
| PMP1E11 | 1.8E4 | 4.0E−4 | 23 | 3.6E3 | 2.0E−3 | 553 |
| PMP2B10 | No reactivity | | | 2.5E3 | 9.7E−4 | 4 |
| PMP1B2 | 4.4E5 | 5.9E−5 | 0.13 | No reactivity | | |

TABLE C-8

Immunization protocol with CTLA4-Ig as antigen

| Day | Llama 119 | Llama 120 | Tissue collection |
|---|---|---|---|
| 0 | 100 µg | 100 µg | 10 ml pre-immune blood |
| 7 | 100 µg | 100 µg | — |
| 14 | 50 µg | 50 µg | — |
| 21 | 50 µg | 50 µg | 10 ml immune blood |
| 28 | 50 µg | 50 µg | — |
| 35 | 50 µg | 50 µg | — |
| 39 | | | 150 ml immune blood lymph node biopsy |
| 43 | | | 150 ml immune blood |
| 49 | 50 µg | 50 µg | — |
| 56 | | | 100 ml immune blood |

TABLE C-9

Size and percentages of inserts of constructed libraries

| | Library size | % insert |
|---|---|---|
| Llama No. 119 | 1.3 × 10E8 | 96 |
| Llama No. 120 | 1.6 × 10E8 | 91 |

TABLE C-10

Protein production yields

| # | Clone | Yield (mg) | Production volume (ml) | Yield (mg/l) |
|---|---|---|---|---|
| 1 | 2A5 | 1.78 | 200 | 8.91 |
| 2 | 2C11 | 0.81 | 200 | 4.05 |
| 3 | 2F2 | 0.66 | 200 | 3.29 |
| 4 | 2F4 | 0.63 | 200 | 3.15 |
| 5 | 2G2 | 0.85 | 200 | 4.27 |
| 6 | 2G9 | 4.82 | 200 | 24.08 |
| 7 | 3A6 | 0.88 | 200 | 4.38 |
| 8 | 3C4 | 0.53 | 200 | 2.66 |
| 9 | 6C10 | 0.38 | 250 | 1.50 |
| 10 | 8E5.4 | 1.71 | 250 | 6.85 |
| 11 | 10G5 | 0.47 | 250 | 1.86 |
| 12 | 11E3 | 0.20 | 250 | 0.78 |
| 13 | 11F1 | 0.82 | 250 | 3.28 |
| 14 | 12H2 | 0.14 | 250 | 0.54 |
| 15 | 13B2 | 0.81 | 250 | 3.24 |
| 16 | 17E3 | 2.81 | 250 | 11.24 |

TABLE C-11

Performance characteristics of selected CTLA4 binding Nanobodies

| # | Clone | Alphascreen IC50 | BIAcore $k_{on}$ (M$^{-1}$s$^{-1}$) | BIAcore $k_{off}$ (s$^{-1}$) | BIAcore $K_D$ (M) | IC50 human CTLA4 binding in FACS (nM) | IC50 cyno CTLA4 binding in FACS (nM) |
|---|---|---|---|---|---|---|---|
| 1 | 2A5 | 4.56E-9 | | 5.30E-03 | | 5.72 | 7.74 |
| 2 | 2C11 | 2.52E-8 | | 0.0235 | | Not saturated at 500 | Not saturated at 500 |
| 3 | 2F2 | 1.55E-9 | 6.13E+06 | 3.91E-03 | 6.38E-10 | 2.56 | 2.42 |
| 4 | 2F4 | 1.14E-9 | 5.69E+06 | 2.66E-03 | 4.66E-10 | 2.38 | 2.36 |
| 5 | 2G2 | 1.58E-9 | 7.42E+06 | 3.55E-03 | 4.78E-10 | 2.28 | 2.08 |
| 6 | 2G9 | 4.80E-9 | 4.35E+06 | 7.32E-03 | 1.69E-09 | 2.47 | 2.66 |
| 7 | 3A6 | 3.33E-8 | | 1.80E-03 | | Not saturated at 500 | Not saturated at 500 |
| 8 | 3C4 | 2.95E-9 | | 0.0205 | | 8.06 | 6.73 |
| 9 | 6C10 | 2.206E-9 | | 0.002790 | | 5.73 | 5.47 |
| 10 | 8E5.4 | 7.724E-9 | | 0.003861 | | Not saturated at 500 | No crossreactivity |
| 11 | 10G5 | 3.313E-9 | | 0.006182 | | 4.65 | No crossreactivity |
| 12 | 10E3 | 1.652E-9 | 7.42E+05 | 4.96E-03 | 1.00E-08 | 4.91 | 4.50 |
| 13 | 11F1 | 1.21E-9 | 1.86E+06 | 1.87E-02 | 1.00E-08 | 4.55 | 5.51 |
| 14 | 12H2 | 1.337E-9 | 3.49E+05 | 2.58E-03 | 7.52E-09 | 5.82 | 5.65 |
| 15 | 13B2 | 1.909E-9 | | 0.006701 | | 3.60 | No crossreactivity |
| 16 | 17E3 | 1.655E-8 | | 0.004891 | | 11.22 | No crossreactivity |

TABLE C-12

IC50 values of monovalent and multivalent CTLA4 binding Nanobodies as determined in alphascreen

| Clone | IC50 (M) | Format | IC50 (M) | Gain vs. monovalent |
|---|---|---|---|---|
| 2F4 | 8.27E−10 | 2F4-2F4-ALB1 | 1.89E−10 | 4.4 |
| 2G9 | 2.01E−09 | 2G9-2G9-ALB1 | 2.58E−10 | 7.8 |
| 11F1 | 1.04E−09 | 11F1-11F1-ALB1 | 1.44E−10 | 7.2 |

TABLE C-13

IC50 values of monovalent and multivalent CTLA4 binding Nanobodies as determined in FACS

| Clone | IC50 (nM) | Format | IC50 (nM) | Gain vs. monovalent |
|---|---|---|---|---|
| 2F4 | 11.4 | 2F4-2F4-ALB1 | 3.6 | 3.2 |
| 2G9 | — | 2G9-2G9-ALB1 | — | — |
| 11F1 | 36.4 | 11F1-11F1-ALB1 | 3.9 | 9.3 |

TABLE C-14

Off rate of monovalent and multivalent CTLA4 binding Nanobodies as determined in BIAcore

| Clone | Off-rate (60s) | Off-rate (300-375s) | Format | Off-rate (60s) | Off-rate (300-375s) | Gain (60s) | Gain (300-375s) |
|---|---|---|---|---|---|---|---|
| 2F4 | 2.63E−03 | 1.63E−03 | 2F4-2F4-ALB1 | 1.77E−03 | 4.25E−04 | 1.49 | 3.84 |
| 2G9 | 5.66E−03 | 3.51E−03 | 2G9-2G9-ALB1 | 2.28E−03 | 6.96E−04 | 2.48 | 5.04 |
| 11F1 | 1.50E−02 | — | 11F1-11F1-ALB1 | 5.82E−03 | 1.03E−05 | 2.58 | 1456.31 |

TABLE C-15

Potency of humanized variants of CTLA4 binding Nanobodies 11F1 and 11E3 determined in alphascreen as described in Example 63

| Clone | IC50 | Loss factor | Comment |
|---|---|---|---|
| 11F1 WT | 1.46E−09 | Reference | |
| 11F1 basic | 1.61E−09 | 1.10 | |
| 11F1 hum1 | 9.90E−10 | 0.68 | |
| 11F1 hum2 | 4.65E−10 | 0.32 | |
| 11F1 hum3 | 6.20E−10 | 0.43 | |
| 11F1 hum4 | 1.29E−09 | 0.88 | |
| 11F1 hum5 | 8.78E−10 | 0.60 | |
| 11E3 WT | 1.74E−09 | Reference | |
| 11E3 basic | 2.06E−08 | 11.86 | |
| 11E3 hum1 | 3.27E−08 | 18.81 | |
| 11E3 hum2 | 2.64E−08 | 15.19 | |
| 11E3 hum3 | NA | NA | Variant no longer inhibits interaction |
| 11E3 hum4 | 1.71E−08 | 9.86 | |

SEQUENCE LISTING (1418 sequences)

SEQ ID NO: 1 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLVQPGGSLRLSCAASGIPFSXXXXXWFRQAPGKQRDSVAXXXXXRFTISRDNAKNTVYLQMNSLKPEDTAVYRCYFXXXXXWGQGTQVTVSS

SEQ ID NO: 2 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVKLEESGGGLVQAGGSLRLSCVGSGRTFSXXXXXWFRLAPGKEREFVAXXXXXRFTISRDTASNRGYLHMNNLTPEDTAVYYCAAXXXXXWGQGTQVTVSS

SEQ ID NO: 3 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVDSGGGLVQAGDSLKLSCALTGGAFTXXXXXWFRQTPGREREFVAXXXXXRFTISRDNAKNMVYLRMNSLIPEDAAVYSCAAXXXXXWGQGTLVTVSS

SEQ ID NO: 4 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVQLVESGGGLVEAGGSLRLSCTASESPFRXXXXXWFRQTSGQEREFVAXXXXXRFTISRDDAKNTVWLHGSTLKPEDTAVYYCAAXXXXXWGQGTQVTVSS

SEQ ID NO: 5 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQGGGSLRLACAASERIFDXXXXXWYRQGPGNERELVAXXXXXRFTISMDYTKQTVYLHMNSLRPEDTGLYYCKIXXXXXWGQGTQVTVSS

SEQ ID NO: 6 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
DVKFVESGGGLVQAGGSLRLSCVASGFNFDXXXXXWFRQAPGKEREEVAXXXXXRFTISSEKDKNSVYLQMNSLKPEDTALYICAGXXXXXWGRGTQVTVSS

SEQ ID NO: 7 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVRLAESGGGLVQSGGSLRLSCVASGSTYTXXXXXWYRQYPGKQRALVAXXXXXRFTIARDSTKDTFCLQMNNLKPEDTAVYYCYAXXXXXWGQGTQVTVSS

SEQ ID NO: 8 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLVQAGGSLRLSCAASGFTSDXXXXXWFRQAPGKPREGVSXXXXXRFTISTDNAKNTVHLLMNRVNAEDTALYYCAVXXXXXWGRGTRVTVSS

SEQ ID NO: 9 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVQLVESGGGLVQPGGSLRLSCQASGDISTXXXXXWYRQVPGKLREFVAXXXXXRFTISGDNAKRAIYLQMNNLKPDDTAVYYCNRXXXXXWGQGTQVTVSP

SEQ ID NO: 10 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVPVVESGGGLVQAGDSLRLFCAVPSFTSTXXXXXWFRQAPGKEREFVAXXXXXRFTISRNATKNTLTLRMDSLKPEDTAVYYCAAXXXXXWGQGTQVTVSS

SEQ ID NO: 11 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLVQAGDSLRLFCTVSGGTASXXXXXWFRQAPGEKREFVAXXXXXRFTIARENAGNMVYLQMNNLKPDDTALYTCAAXXXXXWGRGTQVTVSS

SEQ ID NO: 12 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVESGGDSVQPGDSQTLSCAASGRTNSXXXXXWFRQAPGKERVFLAXXXXXRFTISRDSAKNMMYLQMNNLKPQDTAVYYCAAXXXXXWGQGTQVTVSS

SEQ ID NO: 13 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQAGGSLRLSCVVSGLTSSXXXXXWFRQTPWQERDFVAXXXXXRFTISRDNYKDTVLLEMNFLKPEDTAIYYCAAXXXXXWGQGTQVTVSS

SEQ ID NO: 14 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQAGASLRLSCATSTRTLDXXXXXWFRQAPGRDREFVAXXXXXRFTVSRDSAENTVALQMNSLKPEDTAVYYCAAXXXXXWGQGTRVTVSS

SEQ ID NO: 15 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVQLVESGGGLVQPGGSLRLSCTVSRLTAHXXXXXWFRQAPGKEREAVSXXXXXRFTISRDYAGNTAFLQMDSLKPEDTGVYYCATXXXXXWGQGTQVTVSS

SEQ ID NO: 16 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
EVQLVESGGELVQAGGSLKLSCTASGRNFVXXXXXWFRRAPGKEREFVAXXXXXRFTVSRDNGKNTAYLRMNSLKPEDTADYYCAVXXXXXLGSGTQVTVSS

SEQ ID NO: 17 - protein, 102 aa, Artificial
  GLEW-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQPGGSLRLSCAASGFTFSXXXXXWVRQAPGKVLEWVSXXXXXRFTISRDNAKNTLYLQMNSLKPEDTAVYYCVKXXXXXGSQGTQVTVSS

SEQ ID NO: 18 - protein, 102 aa, Artificial
  GLEW-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLVQPGGSLRLSCVCVSSGCTXXXXXWVRQAPGKAEEWVSXXXXXRFKISRDNAKKTLYLQMNSLGPEDTAMYYCQRXXXXXRGQGTQVTVSS

SEQ ID NO: 19 - protein, 102 aa, Artificial
  GLEW-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLALPGGSLTLSCVFSGSTFSXXXXXWVRHTPGKAEEWVSXXXXXRFTISRDNAKNTLYLEMNSLSPEDTAMYYCGRXXXXXRSKGIQVTVSS

SEQ ID NO: 20 - protein, 102 aa, Artificial
  P,R,S 103-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQAGGSLRLSCAASGRTFSXXXXXWFRQAPGKEREFVAXXXXXRFTISRDNAKNTVYLQMNSLKPEDTAVYYCAAXXXXXRGQGTQVTVSS

SEQ ID NO: 21 - protein, 102 aa, Artificial
  P,R,S 103-class Nanobody
  misc_feature (31)..(35): Xaa is any amino acid
  misc_feature (50)..(54): Xaa is any amino acid
  misc_feature (87)..(91): Xaa is any amino acid
DVQLVESGGDLVQPGGSLRLSCAASGFSFDXXXXXWLRQTPGKGLEWVGXXXXXRFTISRDNAKNMLYLHLNNLKSEDTAVYYCRRXXXXXLGQGTQVTVSS

SEQ ID NO: 22 - protein, 102 aa, Artificial; identical to SEQ ID NO: 18
  P,R,S 103-class Nanobody
  misc_feature (31)..(35): Xaa is any amino acid
  misc_feature (50)..(54): Xaa is any amino acid
  misc_feature (87)..(91): Xaa is any amino acid

SEQ ID NO: 23 - protein, 30 aa, Artificial
  KERE-class Nanobody FW1 sequence
QVQRVESGGGLVQAGGSLRLSCAASGRTSS

SEQ ID NO: 24 - protein, 30 aa, Artificial
  KERE-class Nanobody FW1 sequence
QVQLVESGGGLVQTGDSLSLSCSASGRTFS

SEQ ID NO: 25 - protein, 30 aa, Artificial
  KERE-class Nanobody FW1 sequence
QVKLEESGGGLVQAGDSLRLSCAATGRAFG

SEQ ID NO: 26 - protein, 30 aa, Artificial
  KERE-class Nanobody FW1 sequence
AVQLVESGGGLVQPGESLGLSCVASGRDFV

SEQ ID NO: 27 - protein, 30 aa, Artificial
  KERE-class Nanobody FW1 sequence
EVQLVESGGGLVQAGGSLRLSCEVLGRTAG

SEQ ID NO: 28 - protein, 30 aa, Artificial
  KERE-class Nanobody FW1 sequence
QVQLVESGGGWVQPGGSLRLSCAASETILS

SEQ ID NO: 29 - protein, 30 aa, Artificial
  KERE-class Nanobody FW1 sequence
QVQLVESGGGTVQPGGSLNLSCVASGNTFN

SEQ ID NO: 30 - protein, 30 aa, Artificial
  KERE-class Nanobody FW1 sequence
EVQLVESGGGLAQPGGSLQLSCSAPGFTLD

SEQ ID NO: 31 - protein, 30 aa, Artificial
  KERE-class Nanobody FW1 sequence
AQELEESGGGLVQAGGSLRLSCAASGRTFN

SEQ ID NO: 32 - protein, 22 aa, Artificial
  KERE-class Nanobody FW1 sequence
VESGGGLVQPGGSLRLSCAASG

SEQ ID NO: 33 - protein, 22 aa, Artificial
  KERE-class Nanobody FW1 sequence
VDSGGGLVQAGDSLKLSCALTG

SEQ ID NO: 34 - protein, 22 aa, Artificial
  KERE-class Nanobody FW1 sequence
VDSGGGLVQAGDSLRLSCAASG

SEQ ID NO: 35 - protein, 22 aa, Artificial
  KERE-class Nanobody FW1 sequence
VDSGGGLVEAGGSLRLSCQVSE

SEQ ID NO: 36 - protein, 22 aa, Artificial
  KERE-class Nanobody FW1 sequence
QDSGGGSVQAGGSLKLSCAASG

SEQ ID NO: 37 - protein, 22 aa, Artificial
  KERE-class Nanobody FW1 sequence
VQSGGRLVQAGDSLRLSCAASE

SEQ ID NO: 38 - protein, 22 aa, Artificial
  KERE-class Nanobody FW1 sequence
VESGGTLVQSGDSLKLSCASST

SEQ ID NO: 39 - protein, 22 aa, Artificial
  KERE-class Nanobody FW1 sequence
MESGGDSVQSGGSLTLSCVASG

SEQ ID NO: 40 - protein, 22 aa, Artificial
  KERE-class Nanobody FW1 sequence
QASGGGLVQAGGSLRLSCSASV

SEQ ID NO: 41 - protein, 14 aa, Artificial
  KERE-class Nanobody FW2 sequence
WFRQAPGKEREFVA

SEQ ID NO: 42 - protein, 14 aa, Artificial
  KERE-class Nanobody FW2 sequence
WFRQTPGREREFVA

SEQ ID NO: 43 - protein, 14 aa, Artificial
  KERE-class Nanobody FW2 sequence
WYRQAPGKQREMVA

SEQ ID NO: 44 - protein, 14 aa, Artificial
  KERE-class Nanobody FW2 sequence
WYRQGPGKQRELVA

SEQ ID NO: 45 - protein, 14 aa, Artificial
  KERE-class Nanobody FW2 sequence
WIRQAPGKEREGVS

SEQ ID NO: 46 - protein, 14 aa, Artificial
  KERE-class Nanobody FW2 sequence
WFREAPGKEREGIS

SEQ ID NO: 47 - protein, 14 aa, Artificial
  KERE-class Nanobody FW2 sequence
WYRQAPGKERDLVA

SEQ ID NO: 48 - protein, 14 aa, Artificial
  KERE-class Nanobody FW2 sequence
WFRQAPGKQREEVS

SEQ ID NO: 49 - protein, 14 aa, Artificial
  KERE-class Nanobody FW2 sequence
WFRQPPGKVREFVG

SEQ ID NO: 50 - protein, 32 aa, Artificial
  KERE-class Nanobody FW3 sequence
RFTISRDNAKNTVYLQMNSLKPEDTAVYRCYF

SEQ ID NO: 51 - protein, 32 aa, Artificial
  KERE-class Nanobody FW3 sequence
RFAISRDNNKNTGYLQMNSLEPEDTAVYYCAA

SEQ ID NO: 52 - protein, 32 aa, Artificial
  KERE-class Nanobody FW3 sequence
RFTVARNNAKNTVNLEMNSLKPEDTAVYYCAA

SEQ ID NO: 53 - protein, 32 aa, Artificial
  KERE-class Nanobody FW3 sequence
RFTISRDIAKNTVDLLMNNLEPEDTAVYYCAA

SEQ ID NO: 54 - protein, 32 aa, Artificial
  KERE-class Nanobody FW3 sequence
RLTISRDNAVDTMYLQMNSLKPEDTAVYYCAA

SEQ ID NO: 55 - protein, 32 aa, Artificial
  KERE-class Nanobody FW3 sequence
RFTISRDNAKNTVYLQMDNVKPEDTAIYYCAA

SEQ ID NO: 56 - protein, 32 aa, Artificial
  KERE-class Nanobody FW3 sequence
RFTISKDSGKNTVYLQMTSLKPEDTAVYYCAT

SEQ ID NO: 57 - protein, 32 aa, Artificial
  KERE-class Nanobody FW3 sequence
RFTISRDSAKNMMYLQMNNLKPQDTAVYYCAA

SEQ ID NO: 58 - protein, 32 aa, Artificial
  KERE-class Nanobody FW3 sequence
RFTISRENDKSTVYLQLNSLKPEDTAVYYCAA

SEQ ID NO: 59 - protein, 32 aa, Artificial
  KERE-class Nanobody FW3 sequence
RFTISRDYAGNTAYLQMNSLKPEDTGVYYCAT

SEQ ID NO: 60 - protein, 11 aa, Artificial
  KERE-class Nanobody FW4 sequence
WGQGTQVTVSS

SEQ ID NO: 61 - protein, 11 aa, Artificial
  KERE-class Nanobody FW4 sequence
WGKGTLVTVSS

SEQ ID NO: 62 - protein, 11 aa, Artificial
  KERE-class Nanobody FW4 sequence
RGQGTRVTVSS

SEQ ID NO: 63 - protein, 11 aa, Artificial
  KERE-class Nanobody FW4 sequence
WGLGTQVTISS

SEQ ID NO: 64 - protein, 30 aa, Artificial
  GLEW-class Nanobody FW1 sequence
QVQLVESGGGLVQPGGSLRLSCAASGFTFS

SEQ ID NO: 65 - protein, 30 aa, Artificial
  GLEW-class Nanobody FW1 sequence
EVHLVESGGGLVRPGGSLRLSCAAFGFIFK

SEQ ID NO: 66 - protein, 30 aa, Artificial
  GLEW-class Nanobody FW1 sequence
QVKLEESGGGLAQPGGSLRLSCVASGFTFS

SEQ ID NO: 67 - protein, 30 aa, Artificial
  GLEW-class Nanobody FW1 sequence
EVQLVESGGGLVQPGGSLRLSCVCVSSGCT

SEQ ID NO: 68 - protein, 30 aa, Artificial
  GLEW-class Nanobody FW1 sequence
EVQLVESGGGLALPGGSLTLSCVFSGSTFS

SEQ ID NO: 69 - protein, 22 aa, Artificial
  GLEW-class Nanobody FW1 sequence
VESGGGLVQPGGSLRLSCAASG

SEQ ID NO: 70 - protein, 22 aa, Artificial
  GLEW-class Nanobody FW1 sequence
EESGGGLAQPGGSLRLSCVASG

SEQ ID NO: 71 - protein, 22 aa, Artificial
  GLEW-class Nanobody FW1 sequence
VESGGGLALPGGSLTLSCVFSG

SEQ ID NO: 72 - protein, 14 aa, Artificial
  GLEW-class Nanobody FW2 sequence
WVRQAPGKVLEWVS

SEQ ID NO: 73 - protein, 14 aa, Artificial
  GLEW-class Nanobody FW2 sequence
WVRRPPGKGLEWVS

SEQ ID NO: 74 - protein, 14 aa, Artificial
  GLEW-class Nanobody FW2 sequence
WVRQAPGMGLEWVS

SEQ ID NO: 75 - protein, 14 aa, Artificial
  GLEW-class Nanobody FW2 sequence
WVRQAPGKEPEWVS

SEQ ID NO: 76 - protein, 14 aa, Artificial
  GLEW-class Nanobody FW2 sequence
WVRQAPGKDQEWVS

SEQ ID NO: 77 - protein, 14 aa, Artificial
  GLEW-class Nanobody FW2 sequence
WVRQAPGKAEEWVS

SEQ ID NO: 78 - protein, 14 aa, Artificial
  GLEW-class Nanobody FW2 sequence
WVRQAPGKGLEWVA

SEQ ID NO: 79 - protein, 14 aa, Artificial
  GLEW-class Nanobody FW2 sequence
WVRQAPGRATEWVS

SEQ ID NO: 80 - protein, 32 aa, Artificial
  GLEW-class Nanobody FW3 sequence
RFTISRDNAKNTLYLQMNSLKPEDTAVYYCVK

SEQ ID NO: 81 - protein, 32 aa, Artificial
  GLEW-class Nanobody FW3 sequence
RFTISRDNARNTLYLQMDSLIPEDTALYYCAR

SEQ ID NO: 82 - protein, 32 aa, Artificial
  GLEW-class Nanobody FW3 sequence
RFTSSRDNAKSTLYLQMNDLKPEDTALYYCAR

SEQ ID NO: 83 - protein, 32 aa, Artificial
  GLEW-class Nanobody FW3 sequence
RFIISRDNAKNTLYLQMNSLGPEDTAMYYCQR

SEQ ID NO: 84 - protein, 32 aa, Artificial
  GLEW-class Nanobody FW3 sequence
RFTASRDNAKNTLYLQMNSLKSEDTARYYCAR

SEQ ID NO: 85 - protein, 32 aa, Artificial
  GLEW-class Nanobody FW3 sequence
RFTISRDNAKNTLYLQMDDLQSEDTAMYYCGR

SEQ ID NO: 86 - protein, 11 aa, Artificial
  GLEW-class Nanobody FW4 sequence
GSQGTQVTVSS

SEQ ID NO: 87 - protein, 11 aa, Artificial
  GLEW-class Nanobody FW4 sequence
LRGGTQVTVSS

SEQ ID NO: 88 - protein, 11 aa, Artificial
  GLEW-class Nanobody FW4 sequence
RGQGTLVTVSS

SEQ ID NO: 89 - protein, 11 aa, Artificial
  GLEW-class Nanobody FW4 sequence
RSRGIQVTVSS

SEQ ID NO: 90 - protein, 11 aa, Artificial
  GLEW-class Nanobody FW4 sequence
WGKGTQVTVSS

SEQ ID NO: 91 - protein, 11 aa, Artificial
  GLEW-class Nanobody FW4 sequence
WGQGTQVTVSS

SEQ ID NO: 92 - protein, 30 aa, Artificial
  P,R,S 103-class Nanobody FW1 sequence
AVQLVESGGGLVQAGGSLRLSCAASGRTFS

SEQ ID NO: 93 - protein, 30 aa, Artificial
  P,R,S 103-class Nanobody FW1 sequence
QVQLQESGGGMVQPGGSLRLSCAASGFDFG

SEQ ID NO: 94 - protein, 30 aa, Artificial; identical to SEQ ID NO: 65
  P,R,S 103-class Nanobody FW1 sequence

SEQ ID NO: 95 - protein, 30 aa, Artificial
  P,R,S 103-class Nanobody FW1 sequence
QVQLAESGGGLVQPGGSLKLSCAASRTIVS

SEQ ID NO: 96 - protein, 30 aa, Artificial
  P,R,S 103-class Nanobody FW1 sequence
QEHLVESGGGLVDIGGSLRLSCAASERIFS

SEQ ID NO: 97 - protein, 30 aa, Artificial; identical to SEQ ID NO: 66
  P,R,S 103-class Nanobody FW1 sequence

SEQ ID NO: 98 - protein, 30 aa, Artificial; identical to SEQ ID NO: 67
  P,R,S 103-class Nanobody FW1 sequence

SEQ ID NO: 99 - protein, 30 aa, Artificial; identical to SEQ ID NO: 68
  P,R,S 103-class Nanobody FW1 sequence

SEQ ID NO: 100 - protein, 22 aa, Artificial
  P,R,S 103-class Nanobody FW1 sequence
VESGGGLVQAGGSLRLSCAASG

SEQ ID NO: 101 - protein, 22 aa, Artificial
  P,R,S 103-class Nanobody FW1 sequence
AESGGGLVQPGGSLKLSCAASR

SEQ ID NO: 102 - protein, 14 aa, Artificial
  P,R,S 103-class Nanobody FW2 sequence
WFRQAPGKEREFVA

SEQ ID NO: 103 - protein, 14 aa, Artificial
  P,R,S 103-class Nanobody FW2 sequence
WVRQAPGKVLEWVS

SEQ ID NO: 104 - protein, 14 aa, Artificial
  P,R,S 103-class Nanobody FW2 sequence
WVRRPPGKGLEWVS

SEQ ID NO: 105 - protein, 14 aa, Artificial
  P,R,S 103-class Nanobody FW2 sequence
WIRQAPGKEREGVS

SEQ ID NO: 106 - protein, 14 aa, Artificial
  P,R,S 103-class Nanobody FW2 sequence
WVRQYPGKEPEWVS

SEQ ID NO: 107 - protein, 14 aa, Artificial
  P,R,S 103-class Nanobody FW2 sequence
WFRQPPGKEHEFVA

SEQ ID NO: 108 - protein, 14 aa, Artificial
  P,R,S 103-class Nanobody FW2 sequence
WYRQAPGKRTELVA

SEQ ID NO: 109 - protein, 14 aa, Artificial
  P,R,S 103-class Nanobody FW2 sequence
WLRQAPGQGLEWVS

SEQ ID NO: 110 - protein, 14 aa, Artificial
  P,R,S 103-class Nanobody FW2 sequence
WLRQTPGKGLEWVG

SEQ ID NO: 111 - protein, 14 aa, Artificial
  P,R,S 103-class Nanobody FW2 sequence
WVRQAPGKAEEFVS

SEQ ID NO: 112 - protein, 32 aa, Artificial
  P,R,S 103-class Nanobody FW3 sequence
RFTISRDNAKNTVYLQMNSLKPEDTAVYYCAA

SEQ ID NO: 113 - protein, 32 aa, Artificial; identical to SEQ ID NO: 81
  P,R,S 103-class Nanobody FW3 sequence

SEQ ID NO: 114 - protein, 32 aa, Artificial
  P,R,S 103-class Nanobody FW3 sequence
RFTISRDNAKNEMYLQMNNLKTEDTGVYWCGA

SEQ ID NO: 115 - protein, 32 aa, Artificial
  P,R,S 103-class Nanobody FW3 sequence
RFTISSDSNRNMIYLQMNNLKPEDTAVYYCAA

SEQ ID NO: 116 - protein, 32 aa, Artificial
  P,R,S 103-class Nanobody FW3 sequence
RFTISRDNAKNMLYLHLNNLKSEDTAVYYCRR

SEQ ID NO: 117 - protein, 32 aa, Artificial
  P,R,S 103-class Nanobody FW3 sequence
RFTISRDNAKKTVYLRLNSLNPEDTAVYSCNL

SEQ ID NO: 118 - protein, 32 aa, Artificial
  P,R,S 103-class Nanobody FW3 sequence
RFKISRDNAKKTLYLQMNSLGPEDTAMYYCQR

SEQ ID NO: 119 - protein, 32 aa, Artificial
  P,R,S 103-class Nanobody FW3 sequence
RFTVSRDNGKNTAYLRMNSLKPEDTADYYCAV

SEQ ID NO: 120 - protein, 11 aa, Artificial
  P,R,S 103-class Nanobody FW4 sequence
RGQGTQVTVSS

SEQ ID NO: 121 - protein, 11 aa, Artificial
  P,R,S 103-class Nanobody FW4 sequence
LRGGTQVTVSS

SEQ ID NO: 122 - protein, 11 aa, Artificial
  P,R,S 103-class Nanobody FW4 sequence
GNKGTLVTVSS

SEQ ID NO: 123 - protein, 11 aa, Artificial
  P,R,S 103-class Nanobody FW4 sequence
SSPGTQVTVSS

SEQ ID NO: 124 - protein, 11 aa, Artificial
  P,R,S 103-class Nanobody FW4 sequence
SSQGTLVTVSS

SEQ ID NO: 125 - protein, 11 aa, Artificial
  P,R,S 103-class Nanobody FW4 sequence
RSRGIQVTVSS

SEQ ID NO: 126 - protein, 30 aa, Artificial
  Framework region 1
EVQLVESGGGLVQAGGSLRLSCAASGFTDG

SEQ ID NO: 127 - protein, 30 aa, Artificial
  Framework region 1
EVQLVESGGGLVQAGGSLRLSCAASGPTSS

SEQ ID NO: 128 - protein, 30 aa, Artificial
  Framework region 1
EVQLVESGGGLVQAGGSLRLSCAASGRSFS

SEQ ID NO: 129 - protein, 30 aa, Artificial
  Framework region 1
EVQLVESGGGSVQAGGSLRLSCAATGRTFS

SEQ ID NO: 130 - protein, 30 aa, Artificial
  Framework region 1
EVQLVESGGGLVQAGGSLRLSCAASGRTFS

SEQ ID NO: 131 - protein, 30 aa, Artificial
  Framework region 1
  MISC_FEATURE (28)..(29): occuring spacer consisting of any naturally occuring amino acid
EVQLVESGGGLVQAGGSLRLSCAASGFXXG

SEQ ID NO: 132 - protein, 30 aa, Artificial; identical to SEQ ID NO: 130
  Framework region 1

SEQ ID NO: 133 - protein, 30 aa, Artificial; identical to SEQ ID NO: 126
  Framework region 1

SEQ ID NO: 134 - protein, 30 aa, Artificial
  Framework region 1
EVQLVESGGGLVQPGGSLRLSCAASGFTLD

SEQ ID NO: 135 - protein, 30 aa, Artificial
  Framework region 1
EVQLVESGGGLVQAGGSLRLACAASGLSFS

SEQ ID NO: 136 - protein, 30 aa, Artificial; identical to SEQ ID NO: 130
  Framework region 1

SEQ ID NO: 137 - protein, 30 aa, Artificial
  Framework region 1
EVQLVESGGGLVQAGGSLRLSCTGSQISFS

SEQ ID NO: 138 - protein, 30 aa, Artificial
  Framework region 1
EVQLVESGGGLVQAGGSLRLSCAASGSIFS

SEQ ID NO: 139 - protein, 30 aa, Artificial; identical to SEQ ID NO: 138
  Framework region 1

SEQ ID NO: 140 - protein, 30 aa, Artificial; identical to SEQ ID NO: 138
  Framework region 1

SEQ ID NO: 141 - protein, 30 aa, Artificial
  Framework region 1
EVQLVKSGGGLVQAGGSLRLSCAASGSIFS

SEQ ID NO: 142 - protein, 30 aa, Artificial; identical to SEQ ID NO: 138
  Framework region 1

SEQ ID NO: 143 - protein, 30 aa, Artificial
  Framework region 1
EVQLVKSGGGLVQPGGSLRLSCAASGFIFS

SEQ ID NO: 144 - protein, 30 aa, Artificial; identical to SEQ ID NO: 138
  Framework region 1

SEQ ID NO: 145 - protein, 30 aa, Artificial
  Framework region 1
EVQLVESGGGLVQAGGSLRLSCTASGSIFS

SEQ ID NO: 146 - protein, 5 aa, Artificial
  Complementary determining region 1
IDAMG

SEQ ID NO: 147 - protein, 5 aa, Artificial
  Complementary determining region 1
SYSMG

SEQ ID NO: 148 - protein, 5 aa, Artificial
  Complementary determining region 1
SYVMG

SEQ ID NO: 149 - protein, 5 aa, Artificial
  Complementary determining region 1
SYGMG

SEQ ID NO: 150 - protein, 5 aa, Artificial
  Complementary determining region 1
DYAAG

SEQ ID NO: 151 - protein, 5 aa, Artificial
  Complementary determining region 1
IDAMG

SEQ ID NO: 152 - protein, 5 aa, Artificial
  Complementary determining region 1
SKAMG

SEQ ID NO: 153 - protein, 5 aa, Artificial
  Complementary determining region 1
IDAMG

SEQ ID NO: 154 - protein, 5 aa, Artificial
  Complementary determining region 1
YSAIG

SEQ ID NO: 155 - protein, 5 aa, Artificial
  Complementary determining region 1
FYTMG

SEQ ID NO: 156 - protein, 5 aa, Artificial
  Complementary determining region 1
SKAMG

SEQ ID NO: 157 - protein, 5 aa, Artificial
  Complementary determining region 1
DNTMN

SEQ ID NO: 158 - protein, 5 aa, Artificial
  Complementary determining region 1
IYTMG

SEQ ID NO: 159 - protein, 5 aa, Artificial
  Complementary determining region 1
IYAMG

SEQ ID NO: 160 - protein, 5 aa, Artificial
  Complementary determining region 1
IYDMG

SEQ ID NO: 161 - protein, 5 aa, Artificial
  Complementary determining region 1
IYDMG

SEQ ID NO: 162 - protein, 5 aa, Artificial
  Complementary determining region 1
IYDMG

SEQ ID NO: 163 - protein, 5 aa, Artificial
  Complementary determining region 1
IYAMG

SEQ ID NO: 164 - protein, 5 aa, Artificial
  Complementary determining region 1
IYTMG

SEQ ID NO: 165 - protein, 5 aa, Artificial
  Complementary determining region 1
IDAMG

SEQ ID NO: 166 - protein, 14 aa, Artificial
  Framework region 2
WFRQAPGKEREFVA

SEQ ID NO: 167 - protein, 14 aa, Artificial
  Framework region 2
WFRQAPGKEREFVA

SEQ ID NO: 168 - protein, 14 aa, Artificial
  Framework region 2
WFRQAPGKEREFVA

SEQ ID NO: 169 - protein, 14 aa, Artificial
  Framework region 2
WFRQAPGKEREFVA

SEQ ID NO: 170 - protein, 14 aa, Artificial
  Framework region 2
WFRQAPGKERDFVA

SEQ ID NO: 171 - protein, 14 aa, Artificial
  Framework region 2
WFRQAPGKEREFVA

SEQ ID NO: 172 - protein, 14 aa, Artificial
  Framework region 2
WFRQAPGKERDFVA

SEQ ID NO: 173 - protein, 14 aa, Artificial
  Framework region 2
WFRQAPGKEREFVA

SEQ ID NO: 174 - protein, 14 aa, Artificial
  Framework region 2
WFRQAPGKEREGVS

SEQ ID NO: 175 - protein, 14 aa, Artificial
  Framework region 2
WFRQAPGEERDFVA

SEQ ID NO: 176 - protein, 14 aa, Artificial
  Framework region 2
WFRQAPGKERDFVA

SEQ ID NO: 177 - protein, 14 aa, Artificial
  Framework region 2
WYRQVPGKQRELVA

SEQ ID NO: 178 - protein, 14 aa, Artificial
  Framework region 2
WYRQAPGEQRELVA

SEQ ID NO: 179 - protein, 14 aa, Artificial
  Framework region 2
WYRQAPGKQRELVA

SEQ ID NO: 180 - protein, 14 aa, Artificial
  Framework region 2
WYRQAPGKQRVLVA

SEQ ID NO: 181 - protein, 14 aa, Artificial
  Framework region 2
WYRQAPGKQRELVA

SEQ ID NO: 182 - protein, 14 aa, Artificial
  Framework region 2
WYRQAPGKQRVLVA

SEQ ID NO: 183 - protein, 14 aa, Artificial
  Framework region 2
WYRQAPGKQRELVA

SEQ ID NO: 184 - protein, 14 aa, Artificial
  Framework region 2
WYRQAPGKQRELVA

SEQ ID NO: 185 - protein, 14 aa, Artificial
  Framework region 2
WYRQAPGKQRELVA

SEQ ID NO: 186 - protein, 17 aa, Artificial
  Complementary determining region 2
SIGRSGNSATNVDSVKG

SEQ ID NO: 187 - protein, 17 aa, Artificial
  Complementary determining region 2
AINWSHGVTYYADSVKG

SEQ ID NO: 188 - protein, 17 aa, Artificial
  Complementary determining region 2
AIIGRDIGTYYADSVKG

SEQ ID NO: 189 - protein, 17 aa, Artificial
  Complementary determining region 2
AIHWNSGITYYADSVKG

SEQ ID NO: 190 - protein, 17 aa, Artificial
  Complementary determining region 2
AINWSGGSTYYADSVKG

SEQ ID NO: 191 - protein, 17 aa, Artificial
  Complementary determining region 2
  MISC_FEATURE (3)..(3): occuring spacer consisting of any naturally occuring amino acid
  MISC_FEATURE (8)..(8): occuring spacer consisting of any naturally occuring amino acid
  MISC_FEATURE (11)..(11): occuring spacer consisting of any naturally occuring amino acid
SIXRSGGXATXADSVKG

SEQ ID NO: 192 - protein, 17 aa, Artificial
  Complementary determining region 2
AITWSGGSTYYADHVKG

SEQ ID NO: 193 - protein, 17 aa, Artificial
  Complementary determining region 2
SIGRSGGSATNADSVKG

SEQ ID NO: 194 - protein, 17 aa, Artificial
  Complementary determining region 2
YISSSDGSTYYADSVEG

SEQ ID NO: 195 - protein, 17 aa, Artificial
  Complementary determining region 2
AINWSGGSTLYAESVKG

SEQ ID NO: 196 - protein, 17 aa, Artificial
  Complementary determining region 2
AITWSGGSTYYADHVKG

SEQ ID NO: 197 - protein, 16 aa, Artificial
  Complementary determining region 2
SLSIFGATGYADSVKG

SEQ ID NO: 198 - protein, 16 aa, Artificial
  Complementary determining region 2
AITSGGSTNYADSVKG

SEQ ID NO: 199 - protein, 16 aa, Artificial
  Complementary determining region 2
AITSGGSTNYADSVMG

SEQ ID NO: 200 - protein, 16 aa, Artificial
  Complementary determining region 2
TITSGGSTNYADSVKG

SEQ ID NO: 201 - protein, 16 aa, Artificial
  Complementary determining region 2
AITSGGSTNYADSVKG

SEQ ID NO: 202 - protein, 16 aa, Artificial
  Complementary determining region 2
TITSGGSTNYADSVKG

SEQ ID NO: 203 - protein, 16 aa, Artificial
  Complementary determining region 2
AITSGGSTNYADSVKG

SEQ ID NO: 204 - protein, 16 aa, Artificial
  Complementary determining region 2
AITSGGSTNYADSVKG

SEQ ID NO: 205 - protein, 16 aa, Artificial
  Complementary determining region 2
HISSGGSTNYADSVKG

SEQ ID NO: 206 - protein, 32 aa, Artificial
  Framework region 3
RFTISRDNAKNTMYLQMNSLKPEDTAGYYCAA

SEQ ID NO: 207 - protein, 32 aa, Artificial
  Framework region 3
RFTISRDIAKNTVYLQMNSLKPEDTAVYYCAA

SEQ ID NO: 208 - protein, 32 aa, Artificial
  Framework region 3
RFTISRDNAKTTVYLQMNALKPEDTAVYYCAA

SEQ ID NO: 209 - protein, 32 aa, Artificial
  Framework region 3
RFTISRDNAKNTVYLQMSSLKPEDTAVYICAA

SEQ ID NO: 210 - protein, 32 aa, Artificial
  Framework region 3
RFTISRDNAKNTVYLQMNSLKPEDTAVYYCAS

SEQ ID NO: 211 - protein, 32 aa, Artificial
  Framework region 3
  MISC_FEATURE (19)..(19): occuring spacer consisting of any naturally occuring amino acid
RFTISRDNAKNTMYLQMNXLKPEDTAGYYCAA

SEQ ID NO: 212 - protein, 32 aa, Artificial
  Framework region 3
RFTISRDNAKNTVYLQMNSLKPEDTAVYYCAT

SEQ ID NO: 213 - protein, 32 aa, Artificial; identical to SEQ ID NO: 206
  Framework region 3

SEQ ID NO: 214 - protein, 32 aa, Artificial
  Framework region 3
RFTISRDNAKNTLYLQMNSLKPEDTAVYYCAA

SEQ ID NO: 215 - protein, 32 aa, Artificial; identical to SEQ ID NO: 112
  Framework region 3

SEQ ID NO: 216 - protein, 32 aa, Artificial; identical to SEQ ID NO: 212
  Framework region 3

SEQ ID NO: 217 - protein, 32 aa, Artificial
  Framework region 3
RFTISRDIAGNTVYLQMNDLKIEDTAVYYCKL

SEQ ID NO: 218 - protein, 32 aa, Artificial
  Framework region 3
RFTISRDNAKNTVYLQMNSLKPEDTAVYYCNA

SEQ ID NO: 219 - protein, 32 aa, Artificial; identical to SEQ ID NO: 218
  Framework region 3

SEQ ID NO: 220 - protein, 32 aa, Artificial
  Framework region 3
RFTISRDDAKNTVYLQMNSLKPEDTAVYYCNA

SEQ ID NO: 221 - protein, 32 aa, Artificial; identical to SEQ ID NO: 218
  Framework region 3

SEQ ID NO: 222 - protein, 32 aa, Artificial; identical to SEQ ID NO: 218
  Framework region 3

SEQ ID NO: 223 - protein, 32 aa, Artificial
  Framework region 3
RFAISRDNAKNTVYLQMNSLKPEDTAVYYCNA

SEQ ID NO: 224 - protein, 32 aa, Artificial; identical to SEQ ID NO: 218
  Framework region 3

SEQ ID NO: 225 - protein, 32 aa, Artificial
  Framework region 3
RFTISRDNAKNTVYLQMNSLKPEDTAVYYCTV

SEQ ID NO: 226 - protein, 16 aa, Artificial
  Complementary determining region 3
ATRRAYLPIRIRDYIY

SEQ ID NO: 227 - protein, 14 aa, Artificial
  Complementary determining region 3
NEYGLGSSIYAYKH

SEQ ID NO: 228 - protein, 15 aa, Artificial
  Complementary determining region 3
DSRSRLSGIRSAYDY

SEQ ID NO: 229 - protein, 14 aa, Artificial
  Complementary determining region 3
SSKGLTGTIRAYDD

SEQ ID NO: 230 - protein, 14 aa, Artificial
  Complementary determining region 3
  MISC_FEATURE (13)..(13): occuring spacer consisting of any naturally occuring amino acid
GWGRTTVLADTVXY

SEQ ID NO: 231 - protein, 16 aa, Artificial
  Complementary determining region 3
ATRRPYLPIRISRLYL

SEQ ID NO: 232 - protein, 12 aa, Artificial
  Complementary determining region 3
NPYGLGQVGYDY

SEQ ID NO: 233 - protein, 16 aa, Artificial
  Complementary determining region 3
ATRRPYLPIRIRDYIY

SEQ ID NO: 234 - protein, 15 aa, Artificial
  Complementary determining region 3
GGPFTVSTMPWLANY

SEQ ID NO: 235 - protein, 17 aa, Artificial
  Complementary determining region 3
VRSVGRTYWTRALEYNY

SEQ ID NO: 236 - protein, 12 aa, Artificial
  Complementary determining region 3
NPYGLGQVGYDY

SEQ ID NO: 237 - protein, 10 aa, Artificial
  Complementary determining region 3
GPVRRSRLEY

SEQ ID NO: 238 - protein, 12 aa, Artificial
  Complementary determining region 3
IAHEEGVYRWDF

SEQ ID NO: 239 - protein, 12 aa, Artificial
  Complementary determining region 3
NAHEEGVYRWDF

SEQ ID NO: 240 - protein, 12 aa, Artificial
  Complementary determining region 3
IAHEEGVYRWDF

SEQ ID NO: 241 - protein, 12 aa, Artificial
  Complementary determining region 3
IAYEEGVYRWDF

SEQ ID NO: 242 - protein, 12 aa, Artificial
  Complementary determining region 3
IAHEEGVYRWDF

SEQ ID NO: 243 - protein, 12 aa, Artificial
  Complementary determining region 3
NAHEEGVYRWDF

SEQ ID NO: 244 - protein, 12 aa, Artificial
  Complementary determining region 3
IAHEEGVYRWDF

SEQ ID NO: 245 - protein, 10 aa, Artificial
  Complementary determining region 3
PRETGWDGDY

SEQ ID NO: 246 - protein, 11 aa, Artificial
  Framework region 4
WGQGTQVTVSS

SEQ ID NO: 247 - protein, 11 aa, Artificial
  Framework region 4
WGQGTQVTVSS

SEQ ID NO: 248 - protein, 10 aa, Artificial
  Framework region 4
WGQGTVTVSS

SEQ ID NO: 249 - protein, 11 aa, Artificial
  Framework region 4
WGQGTQVTVSS

SEQ ID NO: 250 - protein, 11 aa, Artificial
  Framework region 4
WGQGTQVTVSS

SEQ ID NO: 251 - protein, 12 aa, Artificial
  Framework region 4
  MISC_FEATURE (1)..(1): occuring spacer consisting of any naturally occuring amino acid
  MISC_FEATURE (5)..(5): occuring spacer consisting of any naturally occuring amino acid
  MISC_FEATURE (7)..(7): occuring spacer consisting of any naturally occuring amino acid
XGPGXHXVTVSS

SEQ ID NO: 252 - protein, 11 aa, Artificial
  Framework region 4
WGQGTQVTVSS

SEQ ID NO: 253 - protein, 11 aa, Artificial
  Framework region 4
WGQGTQVTVSS

SEQ ID NO: 254 - protein, 11 aa, Artificial
  Framework region 4
WGQGTQVTVSS

SEQ ID NO: 255 - protein, 11 aa, Artificial
  Framework region 4
WGQGTQVTVSS

SEQ ID NO: 256 - protein, 11 aa, Artificial
  Framework region 4
WGQGTQVTVSS

SEQ ID NO: 257 - protein, 11 aa, Artificial
  Framework region 4
WGQGTQVTVSS

SEQ ID NO: 258 - protein, 11 aa, Artificial
  Framework region 4
WGQGTQVTVSS

SEQ ID NO: 259 - protein, 11 aa, Artificial
  Framework region 4
WGQGTQVTVSS

SEQ ID NO: 260 - protein, 11 aa, Artificial
  Framework region 4
WGQGTQVTVSS

SEQ ID NO: 261 - protein, 11 aa, Artificial
  Framework region 4
WGQGTQVTVSS

SEQ ID NO: 262 - protein, 11 aa, Artificial
  Framework region 4
WGQGTQVTVSS

SEQ ID NO: 263 - protein, 11 aa, Artificial
  Framework region 4
WGQGTQVTVSS

SEQ ID NO: 264 - protein, 11 aa, Artificial
  Framework region 4
WGQGTQVTVSS

SEQ ID NO: 265 - protein, 11 aa, Artificial
  Framework region 4
WGQGTQVTVSS

SEQ ID NO: 266 - protein, 125 aa, Artificial
  Nanobody directed against B7-1 and/or B7-2
EVQLVESGGGLVQAGGSLRLSCAASGFTDGIDAMGWFRQAPGKEREFVASIGRSGNSATNVDSVKGRFTISRDNAKNTMYLQMNSLKPEDTAGYYCAAATRRAYLPIRIRDYIYWGQGTQVTVSS

SEQ ID NO: 267 - protein, 123 aa, Artificial
  Nanobody directed against B7-1 and/or B7-2
EVQLVESGGGLVQAGGSLRLSCAASGPTSSSYSMGWFRQAPGKEREFVAAINWSHGVTYYADSVKGRFTISRDIAKNTVYLQMNSLKPEDTAVYYCAANEYGLGSSIYAYKHWGQGTQVTVSS

SEQ ID NO: 268 - protein, 123 aa, Artificial
  Nanobody directed against B7-1 and/or B7-2
EVQLVESGGGLVQAGGSLRLSCAASGRSFSSYVMGWFRQAPGKEREFVAAIIGRDIGTYYADSVKGRFTISRDNAKTTVYLQMNALKPEDTAVYYCAADSRSRLSGIRSAYDYWGQGTVTVSS

SEQ ID NO: 269 - protein, 123 aa, Artificial
  Nanobody directed against B7-1 and/or B7-2
EVQLVESGGGSVQAGGSLRLSCAATGRTFSSYGMGWFRQAPGKEREFVAAIHWNSGITYYADSVKGRFTISRDNAKNTVYLQMSSLKPEDTAVYICAASSKGLTGTIRAYDDWGQGTQVTVSS

SEQ ID NO: 270 - protein, 123 aa, Artificial
  Nanobody directed against B7-1 and/or B7-2
  MISC_FEATURE (111)..(111): occuring spacer consisting of any naturally occuring amino acid
EVQLVESGGGLVQAGGSLRLSCAASGRTFSDYAAGWFRQAPGKERDFVAAINWSGGSTYYADSVKGRFTISRDNAKNTVYLQMNSLKPEDTAVYYCASGWGRTTVLADTVXYWGQGTQVTVSS

SEQ ID NO: 271 - protein, 126 aa, Artificial
  Nanobody directed against B7-1 and/or B7-2
  MISC_FEATURE (28)..(29): occuring spacer consisting of any naturally occuring amino acid
  MISC_FEATURE (52)..(52): occuring spacer consisting of any naturally occuring amino acid
  MISC_FEATURE (57)..(57): occuring spacer consisting of any naturally occuring amino acid
  MISC_FEATURE (60)..(60): occuring spacer consisting of any naturally occuring amino acid
  MISC_FEATURE (85)..(85): occuring spacer consisting of any naturally occuring amino acid
  MISC_FEATURE (115)..(115): occuring spacer consisting of any naturally occuring amino acid
  MISC_FEATURE (119)..(119): occuring spacer consisting of any naturally occuring amino acid
  MISC_FEATURE (121)..(121): occuring spacer consisting of any naturally occuring amino acid
EVQLVESGGGLVQAGGSLRLSCAASGFXXGIDAMGWFRQAPGKEREFVASIXRSGGXATXADSVKGRFTISRDNAKNTMYLQMNXLKPEDTAGYYCAAATRRPYLPIRISRLYLXGPGXHXVTVSS

SEQ ID NO: 272 - protein, 121 aa, Artificial
  Nanobody directed against B7-1 and/or B7-2
EVQLVESGGGLVQAGGSLRLSCAASGRTFSSKAMGWFRQAPGKERDFVAAITWSGGSTYYADHVKGRFTISRDNAKNTVYLQMNSLKPEDTAVYYCATNPYGLGQVGYDYWGQGTQVTVSS

SEQ ID NO: 273 - protein, 125 aa, Artificial
  Nanobody directed against B7-1 and/or B7-2
EVQLVESGGGLVQAGGSLRLSCAASGFTDGIDAMGWFRQAPGKEREFVASIGRSGGSATNADSVKGRFTISRDNAKNTMYLQMNSLKPEDTAGYYCAAATRRPYLPIRIRDYIYWGQGTQVTVSS

SEQ ID NO: 274 - protein, 124 aa, Artificial
  Nanobody directed against B7-1 and/or B7-2
EVQLVESGGGLVQPGGSLRLSCAASGFTLDYSAIGWFRQAPGKEREGVSYISSSDGSTYYADSVEGRFTISRDNAKNTLYLQMNSLKPEDTAVYYCAAGGPFTVSTMPWLANYWGQGTQVTVSS

SEQ ID NO: 275 - protein, 126 aa, Artificial
  Nanobody directed against B7-1 and/or B7-2
EVQLVESGGGLVQAGGSLRLACAASGLSFSFYTMGWFRQAPGEERDFVAAINWSGGSTLYAESVKGRFTISRDNAKNTVYLQMNSLKPEDTAVYYCAAVRSVGRTYWTRALEYNYWGQGTQVTVSS

SEQ ID NO: 276 - protein, 121 aa, Artificial; identical to SEQ ID NO: 272
  Nanobody directed against B7-1 and/or B7-2

SEQ ID NO: 277 - protein, 118 aa, Artificial
  Nanobody directed against B7-1 and/or B7-2
EVQLVESGGGLVQAGGSLRLSCTGSQISFSDNTMNWYRQVPGKQRELVASLSIFGATGYADSVKGRFTISRDIAGNTVYLQMNDLKIEDTAVYYCKLGPVRRSRLEYWGQGTQVTVSS

SEQ ID NO: 278 - protein, 120 aa, Artificial
  Nanobody directed against B7-1 and/or B7-2
EVQLVESGGGLVQAGGSLRLSCAASGSIFSIYTMGWYRQAPGEQRELVAAITSGGSTNYADSVKGRFTISRDNAKNTVYLQMNSLKPEDTAVYYCNAIAHEEGVYRWDFWGQGTQVTVSS

SEQ ID NO: 279 - protein, 120 aa, Artificial
  Nanobody directed against B7-1 and/or B7-2
EVQLVESGGGLVQAGGSLRLSCAASGSIFSIYAMGWYRQAPGKQRELVAAITSGGSTNYADSVMGRFTISRDNAKNTVYLQMNSLKPEDTAVYYCNANAHEEGVYRWDFWGQGTQVTVSS

SEQ ID NO: 280 - protein, 120 aa, Artificial
  Nanobody directed against B7-1 and/or B7-2
EVQLVESGGGLVQAGGSLRLSCAASGSIFSIYDMGWYRQAPGKQRVLVATITSGGSTNYADSVKGRFTISRDDAKNTVYLQMNSLKPEDTAVYYCNAIAHEEGVYRWDFWGQGTQVTVSS

SEQ ID NO: 281 - protein, 120 aa, Artificial
  Nanobody directed against B7-1 and/or B7-2
EVQLVKSGGGLVQAGGSLRLSCAASGSIFSIYDMGWYRQAPGKQRELVAAITSGGSTNYADSVKGRFTISRDNAKNTVYLQMNSLKPEDTAVYYCNAIAYEEGVYRWDFWGQGTQVTVSS

SEQ ID NO: 282 - protein, 120 aa, Artificial
  Nanobody directed against B7-1 and/or B7-2
EVQLVESGGGLVQAGGSLRLSCAASGSIFSIYDMGWYRQAPGKQRVLVATITSGGSTNYADSVKGRFTISRDNAKNTVYLQMNSLKPEDTAVYYCNAIAHEEGVYRWDFWGQGTQVTVSS

SEQ ID NO: 283 - protein, 120 aa, Artificial
  Nanobody directed against B7-1 and/or B7-2
EVQLVKSGGGLVQPGGSLRLSCAASGFIFSIYAMGWYRQAPGKQRELVAAITSGGSTNYADSVKGRFAISRDNAKNTVYLQMNSLKPEDTAVYYCNANAHEEGVYRWDFWGQGTQVTVSS

SEQ ID NO: 284 - protein, 120 aa, Artificial
  Nanobody directed against B7-1 and/or B7-2
EVQLVESGGGLVQAGGSLRLSCAASGSIFSIYTMGWYRQAPGKQRELVAAITSGGSTNYADSVKGRFTISRDNAKNTVYLQMNSLKPEDTAVYYCNAIAHEEGVYRWDFWGQGTQVTVSS

SEQ ID NO: 285 - protein, 118 aa, Artificial
  Nanobody directed against B7-1 and/or B7-2
EVQLVESGGGLVQAGGSLRLSCTASGSIFSIDAMGWYRQAPGKQRELVAHISSGGSTNYADSVKGRFTISRDNAKNTVYLQMNSLKPEDTAVYYCTVPRETGWDGDYWGQGTQVTVSS

SEQ ID NO: 286 - protein, 249 aa, Artificial
  Polypeptide comprising at least one Nanobody of the invention and at least one Nanobody that provides for increased half-life
EVQLVESGGGLVQAGGSLRLSCAASGFTDGIDAMGWFRQAPGKEREFVASIGRSGNSATNVDSVKGRFTISRDNAKNTMYLQMNSLKPEDTAGYYCAAATRRAYLPIRIRDYIYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 287 - protein, 247 aa, Artificial
  Polypeptide comprising at least one Nanobody of the invention and at least one Nanobody that provides for increased half-life
EVQLVESGGGLVQAGGSLRLSCAASGPTSSSYSMGWFRQAPGKEREFVAAINWSHGVTYYADSVKGRFTISRDIAKNTVYLQMNSLKPEDTAVYYCAANEYGLGSSIYAYKHWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 288 - protein, 247 aa, Artificial
  Polypeptide comprising at least one Nanobody of the invention and at least one Nanobody that provides for increased half-life
EVQLVESGGGLVQAGGSLRLSCAASGRSFSSYVMGWFRQAPGKEREFVAAIIGRDIGTYYADSVKGRFTISRDNAKTTVYLQMNALKPEDTAVYYCAADSRSRLSGIRSAYDYWGQGTVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 289 - protein, 247 aa, Artificial
  Polypeptide comprising at least one Nanobody of the invention and at least one Nanobody that provides for increased half-life
EVQLVESGGGSVQAGGSLRLSCAATGRTFSSYGMGWFRQAPGKEREFVAAIHWNSGITYYADSVKGRFTISRDNAKNTVYLQMSSLKPEDTAVYICAASSKGLTGTIRAYDDWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 290 - protein, 247 aa, Artificial
  Polypeptide comprising at least one Nanobody of the invention and at least one Nanobody that provides for increased half-life
  MISC_FEATURE (111)..(111): occuring spacer consisting of any naturally occuring amino acid
EVQLVESGGGLVQAGGSLRLSCAASGRTFSDYAAGWFRQAPGKERDFVAAINWSGGSTYYADSVKGRFTISRDNAKNTVYLQMNSLKPEDTAVYYCASGWGRTTVLADTVXYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 291 - protein, 250 aa, Artificial
  Polypeptide comprising at least one Nanobody of the invention and at least one Nanobody that provides for increased half-life
  MISC_FEATURE (28)..(29): occuring spacer consisting of any naturally occuring amino acid
  MISC_FEATURE (52)..(52): occuring spacer consisting of any naturally occuring amino acid
  MISC_FEATURE (57)..(57): occuring spacer consisting of any naturally occuring amino acid
  MISC_FEATURE (60)..(60): occuring spacer consisting of any naturally occuring amino acid
  MISC_FEATURE (85)..(85): occuring spacer consisting of any naturally occuring amino acid
  MISC_FEATURE (115)..(115): occuring spacer consisting of any naturally occuring amino acid
  MISC_FEATURE (119)..(119): occuring spacer consisting of any naturally occuring amino acid
  MISC_FEATURE (121)..(121): occuring spacer consisting of any naturally occuring amino acid
EVQLVESGGGLVQAGGSLRLSCAASGFXXGIDAMGWFRQAPGKEREFVASIXRSGGXATXADSVKGRFTISRDNAKNTMYLQMNXLKPEDTAGYYCAAATRRPYLPIRISRLYLXGPGXHXVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 292 - protein, 245 aa, Artificial
  Polypeptide comprising at least one Nanobody of the invention and at least one Nanobody that provides for increased half-life
EVQLVESGGGLVQAGGSLRLSCAASGRTFSSKAMGWFRQAPGKERDFVAAITWSGGSTYYADHVKGRFTISRDNAKNTVYLQMNSLKPEDTAVYYCATNPYGLGQVGYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 293 - protein, 249 aa, Artificial
  Polypeptide comprising at least one Nanobody of the invention and at least one Nanobody that provides for increased half-life
EVQLVESGGGLVQAGGSLRLSCAASGFTDGIDAMGWFRQAPGKEREFVASIGRSGGSATNADSVKGRFTISRDNAKNTMYLQMNSLKPEDTAGYYCAAATRRPYLPIRIRDYIYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 294 - protein, 248 aa, Artificial
  Polypeptide comprising at least one Nanobody of the invention and at least one Nanobody that provides for increased half-life
EVQLVESGGGLVQPGGSLRLSCAASGFTLDYSAIGWFRQAPGKEREGVSYISSSDGSTYYADSVEGRFTISRDNAKNTLYLQMNSLKPEDTAVYYCAAGGPFTVSTMPWLANYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 295 - protein, 250 aa, Artificial
  Polypeptide comprising at least one Nanobody of the invention and at least one Nanobody that provides for increased half-life
EVQLVESGGGLVQAGGSLRLACAASGLSFSFYTMGWFRQAPGEERDFVAAINWSGGSTLYAESVKGRFTISRDNAKNTVYLQMNSLKPEDTAVYYCAAVRSVGRTYWTRALEYNYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 296 - protein, 245 aa, Artificial; identical to SEQ ID NO: 292
  Polypeptide comprising at least one Nanobody of the invention and at least one Nanobody that provides for increased half-life

SEQ ID NO: 297 - protein, 242 aa, Artificial
  Polypeptide comprising at least one Nanobody of the invention and at least one Nanobody that provides for increased half-life
EVQLVESGGGLVQAGGSLRLSCTGSQISFSDNTMNWYRQVPGKQRELVASLSIFGATGYADSVKGRFTISRDIAGNTVYLQMNDLKIEDTAVYYCKLGPVRRSRLEYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 298 - protein, 244 aa, Artificial
  Polypeptide comprising at least one Nanobody of the invention and at least one Nanobody that provides for increased half-life
EVQLVESGGGLVQAGGSLRLSCAASGSIFSIYTMGWYRQAPGEQRELVAAITSGGSTNYADSVKGRFTISRDNAKNTVYLQMNSLKPEDTAVYYCNAIAHEEGVYRWDFWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 299 - protein, 244 aa, Artificial
  Polypeptide comprising at least one Nanobody of the invention and at least one Nanobody that provides for increased half-life
EVQLVESGGGLVQAGGSLRLSCAASGSIFSIYAMGWYRQAPGKQRELVAAITSGGSTNYADSVMGRFTISRDNAKNTVYLQMNSLKPEDTAVYYCNANAHEEGVYRWDFWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 300 - protein, 244 aa, Artificial
  Polypeptide comprising at least one Nanobody of the invention and at least one Nanobody that provides for increased half-life
EVQLVESGGGLVQAGGSLRLSCAASGSIFSIYDMGWYRQAPGKQRVLVATITSGGSTNYADSVKGRFTISRDDAKNTVYLQMNSLKPEDTAVYYCNAIAHEEGVYRWDFWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 301 - protein, 244 aa, Artificial
  Polypeptide comprising at least one Nanobody of the invention and at least one Nanobody that provides for increased half-life
EVQLVKSGGGLVQAGGSLRLSCAASGSIFSIYDMGWYRQAPGKQRELVAAITSGGSTNYADSVKGRFTISRDNAKNTVYLQMNSLKPEDTAVYYCNAIAYEEGVYRWDFWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 302 - protein, 244 aa, Artificial
  Polypeptide comprising at least one Nanobody of the invention and at least one Nanobody that provides for increased half-life
EVQLVESGGGLVQAGGSLRLSCAASGSIFSIYDMGWYRQAPGKQRVLVATITSGGSTNYADSVKGRFTISRDNAKNTVYLQMNSLKPEDTAVYYCNAIAHEEGVYRWDFWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 303 - protein, 244 aa, Artificial
  Polypeptide comprising at least one Nanobody of the invention and at least one Nanobody that provides for increased half-life
EVQLVKSGGGLVQPGGSLRLSCAASGFIFSIYAMGWYRQAPGKQRELVAAITSGGSTNYADSVKGRFAISRDNAKNTVYLQMNSLKPEDTAVYYCNANAHEEGVYRWDFWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 304 - protein, 244 aa, Artificial
  Polypeptide comprising at least one Nanobody of the invention and at least one Nanobody that provides for increased half-life
EVQLVESGGGLVQAGGSLRLSCAASGSIFSIYTMGWYRQAPGKQRELVAAITSGGSTNYADSVKGRFTISRDNAKNTVYLQMNSLKPEDTAVYYCNAIAHEEGVYRWDFWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 305 - protein, 242 aa, Artificial
  Polypeptide comprising at least one Nanobody of the invention and at least one Nanobody that provides for increased half-life
EVQLVESGGGLVQAGGSLRLSCTASGSIFSIDAMGWYRQAPGKQRELVAHISSGGSTNYADSVKGRFTISRDNAKNTVYLQMNSLKPEDTAVYYCTVPRETGWDGDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 306 - protein, 22 aa, Artificial
  Llama leader sequence
VKKLLFAIPLVVPFYAAQPAMA

SEQ ID NO: 307 - protein, 22 aa, Artificial
  Llama leader sequence
VKKLLFAIPLVVPFYAAQPAIA

SEQ ID NO: 308 - protein, 9 aa, Artificial
  Llama leader sequence
FELASVAQA

SEQ ID NO: 309 - protein, 21 aa, Artificial
  Leader sequence
MKKTAIAIAVALAGLATVAQA

SEQ ID NO: 310 - protein, 21 aa, Artificial
  Leader sequence
MKKTAIAFAVALAGLATVAQA

SEQ ID NO: 311 - protein, 23 aa, Artificial
  N-terminal sequence
AAAEQKLISEEDLNGAAHHHHHH

SEQ ID NO: 312 - protein, 30 aa, Artificial
  Framework region 1
EVQLVESGGGLVQAGKSLRLSCAASGSIFS

SEQ ID NO: 313 - protein, 30 aa, Artificial
  Framework region 1
EVQLVESGGGLVQAGGSLRLSCAASGSIAS

SEQ ID NO: 314 - protein, 30 aa, Artificial
  Framework region 1
EVQLVESGGGLVQAGGSLRLSCAASGSISS

SEQ ID NO: 315 - protein, 30 aa, Artificial
  Framework region 1
EVQLVESGGGLVQAGGSLGLSCAASGSIFS

SEQ ID NO: 316 - protein, 30 aa, Artificial
  Framework region 1
EVQLVESGGGLVQAGGSLRLSCAASGRAFS

SEQ ID NO: 317 - protein, 5 aa, Artificial
  Complementary determining region 1
IHAMG

SEQ ID NO: 318 - protein, 5 aa, Artificial
  Complementary determining region 1
IHAMG

SEQ ID NO: 319 - protein, 5 aa, Artificial
  Complementary determining region 1
IHAMG

SEQ ID NO: 320 - protein, 5 aa, Artificial
  Complementary determining region 1
INAMA

SEQ ID NO: 321 - protein, 5 aa, Artificial
  Complementary determining region 1
SGTMG

SEQ ID NO: 322 - protein, 14 aa, Artificial
  Framework region 2
WFRQAPGKEREFVA

SEQ ID NO: 323 - protein, 14 aa, Artificial
  Framework region 2
WFRQAPGKEREFVA

SEQ ID NO: 324 - protein, 14 aa, Artificial
  Framework region 2
WFRQAPGKEREFVA

SEQ ID NO: 325 - protein, 14 aa, Artificial
  Framework region 2
WFRQAPGKEREFVA

SEQ ID NO: 326 - protein, 14 aa, Artificial
  Framework region 2
WFRRAPGKEREFVA

SEQ ID NO: 327 - protein, 17 aa, Artificial
  Complementary determining region 2
AITWSGGITYYEDSVKG

SEQ ID NO: 328 - protein, 17 aa, Artificial
  Complementary determining region 2
VITWSGGITYYADSVKG

SEQ ID NO: 329 - protein, 17 aa, Artificial
  Complementary determining region 2
AITWSGGITYYADSLKG

SEQ ID NO: 330 - protein, 17 aa, Artificial
  Complementary determining region 2
LISWSGGSTYYEDSVKG

SEQ ID NO: 331 - protein, 17 aa, Artificial
  Complementary determining region 2
SIPWSGGRIYYADSVKG

SEQ ID NO: 332 - protein, 32 aa, Artificial
  Framework region 3
RFTISRDNAKNTVYLQMNSLKPEDTAIYYCAA

SEQ ID NO: 333 - protein, 32 aa, Artificial
  Framework region 3
RFTISRDNAKNTVYLQMNSLKPEDTAIYYCAG

SEQ ID NO: 334 - protein, 32 aa, Artificial
  Framework region 3
RFTISRDNAKNTGYLQMNSLKPEDTAIYYCAA

SEQ ID NO: 335 - protein, 32 aa, Artificial; identical to SEQ ID NO: 332
  Framework region 3

SEQ ID NO: 336 - protein, 32 aa, Artificial
  Framework region 3
RFTISRDNAQNTVYLQMNSLKPEDTAVYYCAV

SEQ ID NO: 337 - protein, 10 aa, Artificial
  Complementary determining region 3
DRAESSWYDY

SEQ ID NO: 338 - protein, 10 aa, Artificial
  Complementary determining region 3
DKHQSSWYDY

SEQ ID NO: 339 - protein, 10 aa, Artificial
  Complementary determining region 3
DRAQSSWYDY

SEQ ID NO: 340 - protein, 10 aa, Artificial
  Complementary determining region 3
DRVDSNWYDY

SEQ ID NO: 341 - protein, 11 aa, Artificial
  Complementary determining region 3
KERSTGWDFAS

SEQ ID NO: 342 - protein, 11 aa, Artificial
  Framework region 4
WGQGTQVTVSS

SEQ ID NO: 343 - protein, 11 aa, Artificial
  Framework region 4
WGQGTQVTVSS

SEQ ID NO: 344 - protein, 11 aa, Artificial
  Framework region 4
WGQGTQVTVSS

SEQ ID NO: 345 - protein, 11 aa, Artificial
  Framework region 4
WGQGTQVTVSS

SEQ ID NO: 346 - protein, 11 aa, Artificial
  Framework region 4
WGQGTQVTVSS

SEQ ID NO: 347 - protein, 119 aa, Artificial
  Nanobody against PD-1
EVQLVESGGGLVQAGKSLRLSCAASGSIFSIHAMGWFRQAPGKEREFVAAITWSGGITYYEDSVKGRFTISRDNAKNTVYLQMNSLKPEDTAIYYCAADRAESSWYDYWGQGTQVTVSS

SEQ ID NO: 348 - protein, 119 aa, Artificial
  Nanobody against PD-1
EVQLVESGGGLVQAGGSLRLSCAASGSIASIHAMGWFRQAPGKEREFVAVITWSGGITYYADSVKGRFTISRDNAKNTVYLQMNSLKPEDTAIYYCAGDKHQSSWYDYWGQGTQVTVSS

SEQ ID NO: 349 - protein, 119 aa, Artificial
  Nanobody against PD-1
EVQLVESGGGLVQAGGSLRLSCAASGSISSIHAMGWFRQAPGKEREFVAAITWSGGITYYADSLKGRFTISRDNAKNTGYLQMNSLKPEDTAIYYCAADRAQSSWYDYWGQGTQVTVSS

SEQ ID NO: 350 - protein, 119 aa, Artificial
  Nanobody against PD-1
EVQLVESGGGLVQAGGSLGLSCAASGSIFSINAMAWFRQAPGKEREFVALISWSGGSTYYEDSVKGRFTISRDNAKNTVYLQMNSLKPEDTAIYYCAADRVDSNWYDYWGQGTQVTVSS

SEQ ID NO: 351 - protein, 120 aa, Artificial
  Nanobody against PD-1
EVQLVESGGGLVQAGGSLRLSCAASGRAFSSGTMGWFRRAPGKEREFVASIPWSGGRIYYADSVKGRFTISRDNAQNTVYLQMNSLKPEDTAVYYCAVKERSTGWDFASWGQGTQVTVSS

SEQ ID NO: 352 - protein, 30 aa, Artificial; identical to SEQ ID NO: 134
  Framework region 1

SEQ ID NO: 353 - protein, 30 aa, Artificial; identical to SEQ ID NO: 134
  Framework region 1

SEQ ID NO: 354 - protein, 30 aa, Artificial
  Framework region 1
EVQLVESGGGLVQPGGSLRLSCAASGFTFD

SEQ ID NO: 355 - protein, 30 aa, Artificial
  Framework region 1
EVQLVESGGGLVQAGGSLRLSCAASGSTFS

SEQ ID NO: 356 - protein, 30 aa, Artificial
  Framework region 1
EVQLVESGGGLVQAGGSLRLSCAASGVDAS

SEQ ID NO: 357 - protein, 30 aa, Artificial
  Framework region 1
EVQLVESGGGLVQAGGSLTISCAASGITFS

SEQ ID NO: 358 - protein, 5 aa, Artificial
  Complementary determining region 1
YYAIG

SEQ ID NO: 359 - protein, 5 aa, Artificial
  Complementary determining region 1
YYAKC

SEQ ID NO: 360 - protein, 5 aa, Artificial
  Complementary determining region 1
YYAIG

SEQ ID NO: 361 - protein, 5 aa, Artificial
  Complementary determining region 1
QYDVG

SEQ ID NO: 362 - protein, 5 aa, Artificial
  Complementary determining region 1
NSAMG

SEQ ID NO: 363 - protein, 5 aa, Artificial
  Complementary determining region 1
DSIVS

SEQ ID NO: 364 - protein, 14 aa, Artificial
  Framework region 2
WFRQAPGKEREWAS

SEQ ID NO: 365 - protein, 14 aa, Artificial
  Framework region 2
WFRQAPGKEREWVS

SEQ ID NO: 366 - protein, 14 aa, Artificial
  Framework region 2
WFRQAPGKAREGVS

SEQ ID NO: 367 - protein, 14 aa, Artificial
  Framework region 2
WYRQAPGKQRELVA

SEQ ID NO: 368 - protein, 14 aa, Artificial
  Framework region 2
WYRQAPGKQREWVA

SEQ ID NO: 369 - protein, 14 aa, Artificial
  Framework region 2
WYRRARGKQREWVA

SEQ ID NO: 370 - protein, 17 aa, Artificial
  Complementary determining region 2
SISSSDGSTYYADSVKG

SEQ ID NO: 371 - protein, 17 aa, Artificial
  Complementary determining region 2
CISSSDGSTYYADSVKG

SEQ ID NO: 372 - protein, 17 aa, Artificial
  Complementary determining region 2
CISGGDNSTYYADSVKG

SEQ ID NO: 373 - protein, 16 aa, Artificial
  Complementary determining region 2
FSSSGGRTIYPDSVKG

SEQ ID NO: 374 - protein, 16 aa, Artificial
  Complementary determining region 2
RITGGGLIAYTDSVKG

SEQ ID NO: 375 - protein, 16 aa, Artificial
  Complementary determining region 2
GISNGGTTKYAESVLG

SEQ ID NO: 376 - protein, 32 aa, Artificial
  Framework region 3
RFTISRDNAKNTVFLQMNSLKPEDTAVYSCAA

SEQ ID NO: 377 - protein, 32 aa, Artificial
  Framework region 3
RFTISRDNAKNTVYLQMNSLKPEDTAVYFCAA

SEQ ID NO: 378 - protein, 32 aa, Artificial; identical to SEQ ID NO: 212
  Framework region 3

SEQ ID NO: 379 - protein, 32 aa, Artificial
  Framework region 3
RFTFSRDNTKNTVYLQMTSLKPEDTAVYYCKI

SEQ ID NO: 380 - protein, 32 aa, Artificial
  Framework region 3
RFTISRDNAKSTVYLQMNSLEPEDTAVYYCNT

SEQ ID NO: 381 - protein, 32 aa, Artificial
  Framework region 3
RFTISRDNAKNMVYLQMNGLNPEDTAVYLCKV

SEQ ID NO: 382 - protein, 17 aa, Artificial
  Complementary determining region 3
SQAPITIATMMKPFYDY

SEQ ID NO: 383 - protein, 14 aa, Artificial
  Complementary determining region 3
RHGGPLTVEYFFDY

SEQ ID NO: 384 - protein, 15 aa, Artificial
  Complementary determining region 3
GGWKYCSGYDPEYIY

SEQ ID NO: 385 - protein, 7 aa, Artificial
  Complementary determining region 3
DWYLNSY

SEQ ID NO: 386 - protein, 6 aa, Artificial
  Complementary determining region 3
INSRDG

SEQ ID NO: 387 - protein, 3 aa, Artificial
  Complementary determining region 3
RQY

SEQ ID NO: 388 - protein, 11 aa, Artificial
  Framework region 4
WGQGTQVTVSS

SEQ ID NO: 389 - protein, 11 aa, Artificial
  Framework region 4
WGQGTQVTVSS

SEQ ID NO: 390 - protein, 11 aa, Artificial
  Framework region 4
WGQGTQVTVSS

SEQ ID NO: 391 - protein, 11 aa, Artificial
  Framework region 4
WGQGTQVTVSS

SEQ ID NO: 392 - protein, 11 aa, Artificial
  Framework region 4
WGQGTQVTVSS

SEQ ID NO: 393 - protein, 11 aa, Artificial
  Framework region 4
WGQGTQVTVSS

SEQ ID NO: 394 - protein, 126 aa, Artificial
  Nanobody against PD-L1
EVQLVESGGGLVQPGGSLRLSCAASGFTLDYYAIGWFRQAPGKEREWASSISSSDGSTYYADSVKGRFTISRDNAKNTVFLQMNSLKPEDTAVYSCAASQAPITIATMMKPFYDYWGQGTQVTVSS

SEQ ID NO: 395 - protein, 123 aa, Artificial
  Nanobody against PD-L1
EVQLVESGGGLVQPGGSLRLSCAASGFTLDYYAKCWFRQAPGKEREWVSCISSSDGSTYYADSVKGRFTISRDNAKNTVYLQMNSLKPEDTAVYFCAARHGGPLTVEYFFDYWGQGTQVTVSS

SEQ ID NO: 396 - protein, 124 aa, Artificial
  Nanobody against PD-L1
EVQLVESGGGLVQPGGSLRLSCAASGFTFDYYAIGWFRQAPGKAREGVSCISGGDNSTYYADSVKGRFTISRDNAKNTVYLQMNSLKPEDTAVYYCATGGWKYCSGYDPEYIYWGQGTQVTVSS

SEQ ID NO: 397 - protein, 115 aa, Artificial
  Nanobody against PD-L1
EVQLVESGGGLVQAGGSLRLSCAASGSTFSQYDVGWYRQAPGKQRELVAFSSSGGRTIYPDSVKGRFTFSRDNTKNTVYLQMTSLKPEDTAVYYCKIDWYLNSYWGQGTQVTVSS

SEQ ID NO: 398 - protein, 114 aa, Artificial
  Nanobody against PD-L1
EVQLVESGGGLVQAGGSLRLSCAASGVDASNSAMGWYRQAPGKQREWVARITGGGLIAYTDSVKGRFTISRDNAKSTVYLQMNSLEPEDTAVYYCNTINSRDGWGQGTQVTVSS

SEQ ID NO: 399 - protein, 111 aa, Artificial
  Nanobody against PD-L1
EVQLVESGGGLVQAGGSLTISCAASGITFSDSIVSWYRRARGKQREWVAGISNGGTTKYAESVLGRFTISRDNAKNMVYLQMNGLNPEDTAVYLCKVRQYWGQGTQVTVSS

SEQ ID NO: 400 - protein, 30 aa, Artificial
  Framework region 1
EVQLVESGGGLVQAGGSLRLSCAASESTVL

SEQ ID NO: 401 - protein, 30 aa, Artificial; identical to SEQ ID NO: 355
  Framework region 1

SEQ ID NO: 402 - protein, 30 aa, Artificial
  Framework region 1
  MISC_FEATURE (27)..(27): occuring spacer consisting of any naturally occuring amino acid
EVQLVESGGGLVQAGGSLRLSCVASGXALK

SEQ ID NO: 403 - protein, 30 aa, Artificial; identical to SEQ ID NO: 130
  Framework region 1

SEQ ID NO: 404 - protein, 30 aa, Artificial
  Framework region 1
EVQLVESGGGLVQTGGSLRLSCAASGFTLD

SEQ ID NO: 405 - protein, 30 aa, Artificial
  Framework region 1
EVQLVESGGGLVQPGGSLRLSCAASGFTFS

SEQ ID NO: 406 - protein, 30 aa, Artificial
  Framework region 1
EVQLVESGGGLVEPGGSLRLSCVASGFTFS

SEQ ID NO: 407 - protein, 5 aa, Artificial
  Complementary determining region 1
INAMG

SEQ ID NO: 408 - protein, 9 aa, Artificial
  Complementary determining region 1
NYVSNYAMG

SEQ ID NO: 409 - protein, 5 aa, Artificial
  Complementary determining region 1
  MISC_FEATURE (2)..(2): occuring spacer consisting of any naturally occuring amino acid
IXVMG

SEQ ID NO: 410 - protein, 5 aa, Artificial
  Complementary determining region 1
SGTMG

SEQ ID NO: 411 - protein, 5 aa, Artificial
  Complementary determining region 1
YYGIG

SEQ ID NO: 412 - protein, 5 aa, Artificial
  Complementary determining region 1
TYTMI

SEQ ID NO: 413 - protein, 5 aa, Artificial
  Complementary determining region 1
SYDMS

SEQ ID NO: 414 - protein, 14 aa, Artificial
  Framework region 2
WYRQAPGKQRELVA

SEQ ID NO: 415 - protein, 14 aa, Artificial
  Framework region 2
WGRQAPGTQRELVA

SEQ ID NO: 416 - protein, 14 aa, Artificial
  Framework region 2
WYRQAPGKQRELVA

SEQ ID NO: 417 - protein, 14 aa, Artificial
  Framework region 2
WFRRAPGKEREFVA

SEQ ID NO: 418 - protein, 14 aa, Artificial
  Framework region 2
WFRQAPGKEREGVS

SEQ ID NO: 419 - protein, 14 aa, Artificial
  Framework region 2
WLRRAPGKGFEWVS

SEQ ID NO: 420 - protein, 14 aa, Artificial
  Framework region 2
WVRQAPGKGLEWVS

SEQ ID NO: 421 - protein, 16 aa, Artificial
  Complementary determining region 2
SISSGGSTNYADSVKG

SEQ ID NO: 422 - protein, 16 aa, Artificial
  Complementary determining region 2
SISNGDTTNYADSVKG

SEQ ID NO: 423 - protein, 16 aa, Artificial
  Complementary determining region 2
AITSGGRTNYSDSVKG

SEQ ID NO: 424 - protein, 17 aa, Artificial
  Complementary determining region 2
SIPWSGGRTYYADSVKD

SEQ ID NO: 425 - protein, 17 aa, Artificial
  Complementary determining region 2
FISGSDGSTYYAESVKG

SEQ ID NO: 426 - protein, 16 aa, Artificial
  Complementary determining region 2
TIDKDGNTNYVDSVKG

SEQ ID NO: 427 - protein, 16 aa, Artificial
  Complementary determining region 2
TINSGGGITYRGSVKG

SEQ ID NO: 428 - protein, 32 aa, Artificial; identical to SEQ ID NO: 218
  Framework region 3

SEQ ID NO: 429 - protein, 32 aa, Artificial
  Framework region 3
RFTISRDNAKNTVYLQMNSLKPEDTAVYYCFE

SEQ ID NO: 430 - protein, 32 aa, Artificial
  Framework region 3
  MISC_FEATURE (10)..(10): occuring spacer consisting of any naturally occuring amino acid
RFTISGDNAXNTVYLQMNSLKSEDTAVYYCRE

SEQ ID NO: 431 - protein, 32 aa, Artificial
  Framework region 3
RFTISRDNAQNTVFLQMNSLKPEDTAVYYCAF

SEQ ID NO: 432 - protein, 32 aa, Artificial
  Framework region 3
RFTISRDKAKNTVYLQMNSLKPEDTAVYYCAA

SEQ ID NO: 433 - protein, 32 aa, Artificial
  Framework region 3
RFAVSRDNTKNTLYLQMNSLKPEDTAMYYCTK

SEQ ID NO: 434 - protein, 32 aa, Artificial
  Framework region 3
RFTISRDNAKNTLYLQMNSLKPEDTAVYYCEN

SEQ ID NO: 435 - protein, 22 aa, Artificial
  Complementary determining region 3
DVYPQDYGLGYVEGKVYYGMDY

SEQ ID NO: 436 - protein, 7 aa, Artificial
  Complementary determining region 3
HQVAGLT

SEQ ID NO: 437 - protein, 10 aa, Artificial
  Complementary determining region 3
WNSGYPPVDY

SEQ ID NO: 438 - protein, 11 aa, Artificial
  Complementary determining region 3
KERSTGWDFAS

SEQ ID NO: 439 - protein, 18 aa, Artificial
  Complementary determining region 3
DPWGPPSIATMTSYEYKH

SEQ ID NO: 440 - protein, 5 aa, Artificial
  Complementary determining region 3
HGSSA

SEQ ID NO: 441 - protein, 6 aa, Artificial
  Complementary determining region 3
GGSSYR

SEQ ID NO: 442 - protein, 11 aa, Artificial
  Framework region 4
WGTGTLVTVSS

SEQ ID NO: 443 - protein, 11 aa, Artificial
  Framework region 4
WGQGTQVTVSS

SEQ ID NO: 444 - protein, 11 aa, Artificial
  Framework region 4
WGQGTQVTVSS

SEQ ID NO: 445 - protein, 11 aa, Artificial
  Framework region 4
WGQGIQVTVSS

SEQ ID NO: 446 - protein, 11 aa, Artificial
  Framework region 4
WGQGTQVTVSS

SEQ ID NO: 447 - protein, 11 aa, Artificial
  Framework region 4
RGQGTRVTVSS

SEQ ID NO: 448 - protein, 11 aa, Artificial
  Framework region 4
RGQGTQVTVSS

SEQ ID NO: 449 - protein, 130 aa, Artificial
  Nanobody against PD-L2
EVQLVESGGGLVQAGGSLRLSCAASESTVLINAMGWYRQAPGKQRELVASISSGGSTNYADSVKGRFTISRDNAKNTVYLQMNSLKPEDTAVYYCNADVYPQDYGLGYVEGKVYYGMDYWGTGTLVTVSS

SEQ ID NO: 450 - protein, 119 aa, Artificial
  Nanobody against PD-L2
EVQLVESGGGLVQAGGSLRLSCAASGSTFSNYVSNYAMGWGRQAPGTQRELVASISNGDTTNYADSVKGRFTISRDNAKNTVYLQMNSLKPEDTAVYYCFEHQVAGLTWGQGTQVTVSS

SEQ ID NO: 451 - protein, 118 aa, Artificial
  Nanobody against PD-L2
  MISC_FEATURE (27)..(27): occuring spacer consisting of any naturally occuring amino acid
  MISC_FEATURE (32)..(32): occuring spacer consisting of any naturally occuring amino acid
  MISC_FEATURE (75)..(75): occuring spacer consisting of any naturally occuring amino acid
EVQLVESGGGLVQAGGSLRLSCVASGXALKIXVMGWYRQAPGKQRELVAAITSGGRTNYSDSVKGRFTISGDNAXNTVYLQMNSLKSEDTAVYYCREWNSGYPPVDYWGQGTQVTVSS

SEQ ID NO: 452 - protein, 120 aa, Artificial
  Nanobody against PD-L2
EVQLVESGGGLVQAGGSLRLSCAASGRTFSSGTMGWFRRAPGKEREFVASIPWSGGRTYYADSVKDRFTISRDNAQNTVFLQMNSLKPEDTAVYYCAFKERSTGWDFASWGQGIQVTVSS

SEQ ID NO: 453 - protein, 127 aa, Artificial
  Nanobody against PD-L2
EVQLVESGGGLVQTGGSLRLSCAASGFTLDYYGIGWFRQAPGKEREGVSFISGSDGSTYYAESVKGRFTISRDKAKNTVYLQMNSLKPEDTAVYYCAADPWGPPSIATMTSYEYKHWGQGTQVTVSS

SEQ ID NO: 454 - protein, 113 aa, Artificial
  Nanobody against PD-L2
EVQLVESGGGLVQPGGSLRLSCAASGFTFSTYTMIWLRRAPGKGFEWVSTIDKDGNTNYVDSVKGRFAVSRDNTKNTLYLQMNSLKPEDTAMYYCTKHGSSARGQGTRVTVSS

SEQ ID NO: 455 - protein, 114 aa, Artificial
  Nanobody against PD-L2
EVQLVESGGGLVEPGGSLRLSCVASGFTFSSYDMSWVRQAPGKGLEWVSTINSGGGITYRGSVKGRFTISRDNAKNTLYLQMNSLKPEDTAVYYCENGGSSYRRGQGTQVTVSS

SEQ ID NO: 456 - protein, 30 aa, Artificial
  Framework region 1
EVQLVESGGGLVQAGGSLRLSCALSGRAVS

SEQ ID NO: 457 - protein, 30 aa, Artificial
  Framework region 1
EVQLVESGGGLVQPGGSLRLSCAASRSISS

SEQ ID NO: 458 - protein, 30 aa, Artificial
  Framework region 1
EVQLVESGGGLVQAGGSLRLSCAASGIAFS

SEQ ID NO: 459 - protein, 30 aa, Artificial
  Framework region 1
EVQLVESGGGLVQTGGSLRLSCAASSSTST

SEQ ID NO: 460 - protein, 30 aa, Artificial
  Framework region 1
EVQLVESGGGLVQAGGSLRLSCASSGSTFS

SEQ ID NO: 461 - protein, 30 aa, Artificial
  Framework region 1
EVQLVESGGALVQPGGSLRLSCAASGFTLG

SEQ ID NO: 462 - protein, 30 aa, Artificial; identical to SEQ ID NO: 461
  Framework region 1

SEQ ID NO: 463 - protein, 7 aa, Artificial
  Complementary determining region 1
IAATAMG

SEQ ID NO: 464 - protein, 5 aa, Artificial
  Complementary determining region 1
FNLLG

SEQ ID NO: 465 - protein, 5 aa, Artificial
  Complementary determining region 1
IDIMD

SEQ ID NO: 466 - protein, 7 aa, Artificial
  Complementary determining region 1
SSIDVMG

SEQ ID NO: 467 - protein, 5 aa, Artificial
  Complementary determining region 1
IDVMG

SEQ ID NO: 468 - protein, 5 aa, Artificial
  Complementary determining region 1
DYVIG

SEQ ID NO: 469 - protein, 5 aa, Artificial
  Complementary determining region 1
DYVIG

SEQ ID NO: 470 - protein, 14 aa, Artificial
  Framework region 2
WYRQAPGKQRELVA

SEQ ID NO: 471 - protein, 14 aa, Artificial
  Framework region 2
WYRQAPGKQRELVA

SEQ ID NO: 472 - protein, 14 aa, Artificial
  Framework region 2
WYRQAPGKERELVA

SEQ ID NO: 473 - protein, 14 aa, Artificial
  Framework region 2
WYRQSPGKQRELVA

SEQ ID NO: 474 - protein, 14 aa, Artificial
  Framework region 2
WYRQAPGKVRERVA

SEQ ID NO: 475 - protein, 14 aa, Artificial
  Framework region 2
WFRQAPGKEREWVS

SEQ ID NO: 476 - protein, 14 aa, Artificial
  Framework region 2
WFRQAPGKEREWVS

SEQ ID NO: 477 - protein, 16 aa, Artificial
  Complementary determining region 2
ARWSGGSIQYLDSVKG

SEQ ID NO: 478 - protein, 16 aa, Artificial
  Complementary determining region 2
HLLSGGSTVYPDSVKG

SEQ ID NO: 479 - protein, 16 aa, Artificial
  Complementary determining region 2
TISGGGSTNYADSVKG

SEQ ID NO: 480 - protein, 16 aa, Artificial
  Complementary determining region 2
SISSFGSTYYADSVKG

SEQ ID NO: 481 - protein, 16 aa, Artificial
  Complementary determining region 2
IIGTGGFPVYADSVKG

SEQ ID NO: 482 - protein, 17 aa, Artificial
  Complementary determining region 2
GISSRDDTTYYANSVKG

SEQ ID NO: 483 - protein, 17 aa, Artificial
  Complementary determining region 2
GISSRDGTTYYADSVKG

SEQ ID NO: 484 - protein, 32 aa, Artificial
  Framework region 3
RFTISRDNAKNTVYLQMNSLTPEDTAVYYCNT

SEQ ID NO: 485 - protein, 32 aa, Artificial
  Framework region 3
RFTVSRDNTKNTVYLQMNSLKPEDTAVYYCNA

SEQ ID NO: 486 - protein, 32 aa, Artificial
  Framework region 3
RFIVSRDNAKNILYLQMNSLKPDDTAVYYCNA

SEQ ID NO: 487 - protein, 32 aa, Artificial
  Framework region 3
RFIISRDNAKNTVNLQMNNLKLEDTAVHFCNL

SEQ ID NO: 488 - protein, 32 aa, Artificial; identical to SEQ ID NO: 218
  Framework region 3

SEQ ID NO: 489 - protein, 32 aa, Artificial
  Framework region 3
RFTISRDNAKNTMYLQMNSLKPEDSAVYYCAL

SEQ ID NO: 490 - protein, 32 aa, Artificial
  Framework region 3
RFTISRDNAKNTMYLQMNSLKPEDTAVYYCAL

SEQ ID NO: 491 - protein, 7 aa, Artificial
  Complementary determining region 3
LPWRANY

SEQ ID NO: 492 - protein, 8 aa, Artificial
  Complementary determining region 3
IAPALGSS

SEQ ID NO: 493 - protein, 10 aa, Artificial
  Complementary determining region 3
RRLIYGRTVY

SEQ ID NO: 494 - protein, 11 aa, Artificial
  Complementary determining region 3
RRLSPPPLLDY

SEQ ID NO: 495 - protein, 8 aa, Artificial
  Complementary determining region 3
ARLVALGS

SEQ ID NO: 496 - protein, 15 aa, Artificial
  Complementary determining region 3
RSGIAVARAPTNYDY

SEQ ID NO: 497 - protein, 15 aa, Artificial
  Complementary determining region 3
RSGIAVARAPSNYDY

SEQ ID NO: 498 - protein, 11 aa, Artificial
  Framework region 4
SGQGTQVTVSS

SEQ ID NO: 499 - protein, 11 aa, Artificial
  Framework region 4
WGQGTQVTVSS

SEQ ID NO: 500 - protein, 11 aa, Artificial
  Framework region 4
WGQGTQVTVSS

SEQ ID NO: 501 - protein, 11 aa, Artificial
  Framework region 4
WGQGTQVTVSS

SEQ ID NO: 502 - protein, 11 aa, Artificial
  Framework region 4
WGQGTQVTVSS

SEQ ID NO: 503 - protein, 11 aa, Artificial
  Framework region 4
WGQGTQVTVSS

SEQ ID NO: 504 - protein, 11 aa, Artificial
  Framework region 4
WGQGTQVTVSS

SEQ ID NO: 505 - protein, 117 aa, Artificial
  Nanobody against ICOSL
EVQLVESGGGLVQAGGSLRLSCALSGRAVSIAATAMGWYRQAPGKQRELVAARWSGGSIQYLDSVKGRFTISRDNAKNTVYLQMNSLTPEDTAVYYCNTLPWRANYSGQGTQVTVSS

SEQ ID NO: 506 - protein, 116 aa, Artificial
  Nanobody against ICOSL
EVQLVESGGGLVQPGGSLRLSCAASRSISSFNLLGWYRQAPGKQRELVAHLLSGGSTVYPDSVKGRFTVSRDNTKNTVYLQMNSLKPEDTAVYYCNAIAPALGSSWGQGTQVTVSS

SEQ ID NO: 507 - protein, 118 aa, Artificial
  Nanobody against ICOSL
EVQLVESGGGLVQAGGSLRLSCAASGIAFSIDIMDWYRQAPGKERELVATISGGGSTNYADSVKGRFIVSRDNAKNILYLQMNSLKPDDTAVYYCNARRLIYGRTVYWGQGTQVTVSS

SEQ ID NO: 508 - protein, 121 aa, Artificial
  Nanobody against ICOSL
EVQLVESGGGLVQTGGSLRLSCAASSSTSTSSIDVMGWYRQSPGKQRELVASISSFGSTYYADSVKGRFIISRDNAKNTVNLQMNNLKLEDTAVHFCNLRRLSPPPLLDYWGQGTQVTVSS

SEQ ID NO: 509 - protein, 116 aa, Artificial
  Nanobody against ICOSL
EVQLVESGGGLVQAGGSLRLSCASSGSTFSIDVMGWYRQAPGKVRERVAIIGTGGFPVYADSVKGRFTISRDNAKNTVYLQMNSLKPEDTAVYYCNAARLVALGSWGQGTQVTVSS

SEQ ID NO: 510 - protein, 124 aa, Artificial
  Nanobody against ICOSL
EVQLVESGGALVQPGGSLRLSCAASGFTLGDYVIGWFRQAPGKEREWVSGISSRDDTTYYANSVKGRFTISRDNAKNTMYLQMNSLKPEDSAVYYCALRSGIAVARAPTNYDYWGQGTQVTVSS

SEQ ID NO: 511 - protein, 124 aa, Artificial
  Nanobody against ICOSL
EVQLVESGGALVQPGGSLRLSCAASGFTLGDYVIGWFRQAPGKEREWVSGISSRDGTTYYADSVKGRFTISRDNAKNTMYLQMNSLKPEDTAVYYCALRSGIAVARAPSNYDYWGQGTQVTVSS

SEQ ID NO: 512 - protein, 30 aa, Artificial
  Framework region 1
EVQLVESGGGLVQAGGSLRLSCAASGLTFS

SEQ ID NO: 513 - protein, 30 aa, Artificial; identical to SEQ ID NO: 130
  Framework region 1

SEQ ID NO: 514 - protein, 30 aa, Artificial
  Framework region 1
EVQLVESGGGLVQAGGSLRLSCATSGRTFS

SEQ ID NO: 515 - protein, 30 aa, Artificial
  Framework region 1
EVQLVESGGGLVQAGGSLRLSCKAAGRTFS

SEQ ID NO: 516 - protein, 30 aa, Artificial; identical to SEQ ID NO: 134
  Framework region 1

SEQ ID NO: 517 - protein, 30 aa, Artificial
  Framework region 1
EVQLVESGGGLVQAGGSLRLSCAASGFTFD

SEQ ID NO: 518 - protein, 5 aa, Artificial
  Complementary determining region 1
NYVMG

SEQ ID NO: 519 - protein, 5 aa, Artificial
  Complementary determining region 1
SYVMG

SEQ ID NO: 520 - protein, 5 aa, Artificial
  Complementary determining region 1
SDVMG

SEQ ID NO: 521 - protein, 5 aa, Artificial
  Complementary determining region 1
SYAMG

SEQ ID NO: 522 - protein, 5 aa, Artificial
  Complementary determining region 1
AYAIH

SEQ ID NO: 523 - protein, 5 aa, Artificial
  Complementary determining region 1
DYAIG

SEQ ID NO: 524 - protein, 14 aa, Artificial
  Framework region 2
WFRQAPGKEREFVG

SEQ ID NO: 525 - protein, 14 aa, Artificial
  Framework region 2
WFRQAPGKEREFVA

SEQ ID NO: 526 - protein, 14 aa, Artificial
  Framework region 2
WFRQAPGKEREFVA

SEQ ID NO: 527 - protein, 14 aa, Artificial
  Framework region 2
WFRQAPGKEREFVA

SEQ ID NO: 528 - protein, 14 aa, Artificial
  Framework region 2
WFRQAPGKEREGVS

SEQ ID NO: 529 - protein, 14 aa, Artificial
  Framework region 2
WFRQAPGKEREGVA

SEQ ID NO: 530 - protein, 17 aa, Artificial
  Complementary determining region 2
TISWDGSDTYYTHSVKG

SEQ ID NO: 531 - protein, 14 aa, Artificial
  Complementary determining region 2
AHSWYADYADSVKG

SEQ ID NO: 532 - protein, 17 aa, Artificial
  Complementary determining region 2
AINRSGHSTSYTGSVKG

SEQ ID NO: 533 - protein, 17 aa, Artificial
  Complementary determining region 2
SIEWDGGGAYYEEAVKG

SEQ ID NO: 534 - protein, 17 aa, Artificial
  Complementary determining region 2
CISSSDGSTYYANSVKG

SEQ ID NO: 535 - protein, 17 aa, Artificial
  Complementary determining region 2
CVSNSDGSTYYANSVKG

SEQ ID NO: 536 - protein, 32 aa, Artificial
  Framework region 3
RFTISRDNAKNVVNLQMNSLKPEDTAVYYCAA

SEQ ID NO: 537 - protein, 32 aa, Artificial
  Framework region 3
RFSISRDNDKNTVYLQMNSLKPEDTAVYYCAA

SEQ ID NO: 538 - protein, 32 aa, Artificial
  Framework region 3
RFAISRDNTKNTVYLQMNSLKPEDTAVYYCAL

SEQ ID NO: 539 - protein, 32 aa, Artificial
  Framework region 3
RFTISRDNTKNTVYLQMDSLRPEDTAVYYCAA

SEQ ID NO: 540 - protein, 32 aa, Artificial
  Framework region 3
RFTISRDNAKNAVYLQMNSLKPEDTAVYYCAT

SEQ ID NO: 541 - protein, 32 aa, Artificial
  Framework region 3
RFTISSDNAKNTVYLQMNSLKPEDTAVYYCAA

SEQ ID NO: 542 - protein, 17 aa, Artificial
  Complementary determining region 3
DYRPGGLLSLGKNEYDY

SEQ ID NO: 543 - protein, 14 aa, Artificial
  Complementary determining region 3
SRSQGRRYANSYES

SEQ ID NO: 544 - protein, 16 aa, Artificial
  Complementary determining region 3
RLWSDYLAQKSGEYNY

SEQ ID NO: 545 - protein, 15 aa, Artificial
  Complementary determining region 3
SRWRTALTNYYDVAD

SEQ ID NO: 546 - protein, 13 aa, Artificial
  Complementary determining region 3
AKRCWGLSYEYDY

SEQ ID NO: 547 - protein, 16 aa, Artificial
  Complementary determining region 3
DSRCWGWGMLHMRHGD

SEQ ID NO: 548 - protein, 11 aa, Artificial
  Framework region 4
WGQGTQVTVSS

SEQ ID NO: 549 - protein, 11 aa, Artificial
  Framework region 4
WGQGTQVTVSS

SEQ ID NO: 550 - protein, 11 aa, Artificial
  Framework region 4
WGQGTQVTVSS

SEQ ID NO: 551 - protein, 11 aa, Artificial
  Framework region 4
WGQGTQVTVSS

SEQ ID NO: 552 - protein, 11 aa, Artificial
  Framework region 4
WGQGTQVTVSS

SEQ ID NO: 553 - protein, 11 aa, Artificial
  Framework region 4
RGQGTQVTVSS

SEQ ID NO: 554 - protein, 126 aa, Artificial
  Nanobody against CD28
EVQLVESGGGLVQAGGSLRLSCAASGLTFSNYVMGWFRQAPGKEREFVGTISWDGSDTYYTHSVKGRFTISRDNAKNVVNLQMNSLKPEDTAVYYCAADYRPGGLLSLGKNEYDYWGQGTQVTVSS

SEQ ID NO: 555 - protein, 120 aa, Artificial
  Nanobody against CD28
EVQLVESGGGLVQAGGSLRLSCAASGRTFSSYVMGWFRQAPGKEREFVAAHSWYADYADSVKGRFSISRDNDKNTVYLQMNSLKPEDTAVYYCAASRSQGRRYANSYESWGQGTQVTVSS

SEQ ID NO: 556 - protein, 125 aa, Artificial
  Nanobody against CD28
EVQLVESGGGLVQAGGSLRLSCATSGRTFSSDVMGWFRQAPGKEREFVAAINRSGHSTSYTGSVKGRFAISRDNTKNTVYLQMNSLKPEDTAVYYCALRLWSDYLAQKSGEYNYWGQGTQVTVSS

SEQ ID NO: 557 - protein, 124 aa, Artificial
  Nanobody against CD28
EVQLVESGGGLVQAGGSLRLSCKAAGRTFSSYAMGWFRQAPGKEREFVASIEWDGGGAYYEEAVKGRFTISRDNTKNTVYLQMDSLRPEDTAVYYCAASRWRTALTNYYDVADWGQGTQVTVSS

SEQ ID NO: 558 - protein, 122 aa, Artificial
  Nanobody against CD28
EVQLVESGGGLVQPGGSLRLSCAASGFTLDAYAIHWFRQAPGKEREGVSCISSSDGSTYYANSVKGRFTISRDNAKNAVYLQMNSLKPEDTAVYYCATAKRCWGLSYEYDYWGQGTQVTVSS

SEQ ID NO: 559 - protein, 125 aa, Artificial
  Nanobody against CD28
EVQLVESGGGLVQAGGSLRLSCAASGFTFDDYAIGWFRQAPGKEREGVACVSNSDGSTYYANSVKGRFTISSDNAKNTVYLQMNSLKPEDTAVYYCAADSRCWGWGMLHMRHGDRGQGTQVTVSS

SEQ ID NO: 560 - protein, 30 aa, Artificial
  Framework region 1
EVQLVESGGGLVQPGGSLRLSCAASGSILS

SEQ ID NO: 561 - protein, 30 aa, Artificial
  Framework region 1
EVQLVESGGGLVQAGGSLRLSCAASGRTSS

SEQ ID NO: 562 - protein, 30 aa, Artificial
  Framework region 1
EVQLVESGGGLVQAGGSLRLSCAASGGTFS

SEQ ID NO: 563 - protein, 30 aa, Artificial
  Framework region 1
EVQLVESGGGLVQPGESLRLSCAASKSIFS

SEQ ID NO: 564 - protein, 30 aa, Artificial
  Framework region 1
EVQLVESGGGLVQAGGSLRLSCAAPGRTFS

SEQ ID NO: 565 - protein, 30 aa, Artificial; identical to SEQ ID NO: 134
  Framework region 1

SEQ ID NO: 566 - protein, 30 aa, Artificial
  Framework region 1
EVQLVESGGGLVQTGGSLRLSCAASGRTFS

SEQ ID NO: 567 - protein, 30 aa, Artificial
  Framework region 1
EVQLVESGGGLVQAGGSLRLSCAASGRTLT

SEQ ID NO: 568 - protein, 30 aa, Artificial
  Framework region 1
EVQLVESGGGLVEPGGSLRLSCAASGSISS

SEQ ID NO: 569 - protein, 30 aa, Artificial; identical to SEQ ID NO: 568
  Framework region 1

SEQ ID NO: 570 - protein, 30 aa, Artificial; identical to SEQ ID NO: 568
  Framework region 1

SEQ ID NO: 571 - protein, 30 aa, Artificial
  Framework region 1
EVQLVESGGGLVQTGGSLRLSCAASGSISS

SEQ ID NO: 572 - protein, 30 aa, Artificial; identical to SEQ ID NO: 134
  Framework region 1

SEQ ID NO: 573 - protein, 30 aa, Artificial; identical to SEQ ID NO: 134
  Framework region 1

SEQ ID NO: 574 - protein, 30 aa, Artificial; identical to SEQ ID NO: 134
  Framework region 1

SEQ ID NO: 575 - protein, 30 aa, Artificial; identical to SEQ ID NO: 134
  Framework region 1

SEQ ID NO: 576 - protein, 30 aa, Artificial; identical to SEQ ID NO: 134
  Framework region 1

SEQ ID NO: 577 - protein, 30 aa, Artificial; identical to SEQ ID NO: 134
  Framework region 1

SEQ ID NO: 578 - protein, 30 aa, Artificial; identical to SEQ ID NO: 562
  Framework region 1

SEQ ID NO: 579 - protein, 30 aa, Artificial
  Framework region 1
EMQLVESGGGLVQAGGSLRLSCAASGGTFS

SEQ ID NO: 580 - protein, 30 aa, Artificial; identical to SEQ ID NO: 562
  Framework region 1

SEQ ID NO: 581 - protein, 30 aa, Artificial; identical to SEQ ID NO: 562
  Framework region 1

SEQ ID NO: 582 - protein, 30 aa, Artificial
  Framework region 1
KVQLVESGGGLVQAGGSLRLSCAAPGRTFS

SEQ ID NO: 583 - protein, 30 aa, Artificial; identical to SEQ ID NO: 564
  Framework region 1

SEQ ID NO: 584 - protein, 30 aa, Artificial
  Framework region 1
EVQLVESGGGLVQPGGSLRLSCAAPGRTFS

SEQ ID NO: 585 - protein, 30 aa, Artificial
  Framework region 1
EVQLVESGGGLVQPGGSLRLSCVASGIHFA

SEQ ID NO: 586 - protein, 30 aa, Artificial
  Framework region 1
EVQLVESGGGLVQPAGSLRLSCADSGSIFS

SEQ ID NO: 587 - protein, 30 aa, Artificial
  Framework region 1
EVQLVESGGGLVQPGGSLRLSCADAGSIFS

SEQ ID NO: 588 - protein, 30 aa, Artificial
  Framework region 1
KVQLVESGGGLVQPGGSLRLSCAASGSDFS

SEQ ID NO: 589 - protein, 30 aa, Artificial
  Framework region 1
EMQLVESGGGLVQPGGSLRLSCAASGNIFS

SEQ ID NO: 590 - protein, 30 aa, Artificial
  Framework region 1
EVQLVESGGGLVQPGGSLRLSCAASGNIFS

SEQ ID NO: 591 - protein, 30 aa, Artificial
  Framework region 1
EVQLVESGGGLVQPGGSLRLSCTASGNIFS

SEQ ID NO: 592 - protein, 30 aa, Artificial; identical to SEQ ID NO: 590
  Framework region 1

SEQ ID NO: 593 - protein, 30 aa, Artificial
  Framework region 1
EVQLVESGGGLVQPGGSLRLSCAASGNIFT

SEQ ID NO: 594 - protein, 30 aa, Artificial; identical to SEQ ID NO: 593
  Framework region 1

SEQ ID NO: 595 - protein, 30 aa, Artificial; identical to SEQ ID NO: 593
  Framework region 1

SEQ ID NO: 596 - protein, 30 aa, Artificial
  Framework region 1
EVQLVESGGGLVQPGGSLRLSCAASRDIFT

SEQ ID NO: 597 - protein, 30 aa, Artificial; identical to SEQ ID NO: 593
  Framework region 1

SEQ ID NO: 598 - protein, 30 aa, Artificial; identical to SEQ ID NO: 593
  Framework region 1

SEQ ID NO: 599 - protein, 30 aa, Artificial; identical to SEQ ID NO: 593
  Framework region 1

SEQ ID NO: 600 - protein, 30 aa, Artificial
  Framework region 1
EVQLVESGGGLVQPGGSLRLSCAASGRTSS

SEQ ID NO: 601 - protein, 30 aa, Artificial
  Framework region 1
EVQLMESGGGLVTAGGSLRLSCAASGGTFG

SEQ ID NO: 602 - protein, 30 aa, Artificial; identical to SEQ ID NO: 562
  Framework region 1

SEQ ID NO: 603 - protein, 30 aa, Artificial; identical to SEQ ID NO: 566
  Framework region 1

SEQ ID NO: 604 - protein, 30 aa, Artificial; identical to SEQ ID NO: 566
  Framework region 1

SEQ ID NO: 605 - protein, 30 aa, Artificial
  Framework region 1
EVQLMESGGGLVQTGGSLRLSCVASGRTFS

SEQ ID NO: 606 - protein, 30 aa, Artificial; identical to SEQ ID NO: 566
  Framework region 1

SEQ ID NO: 607 - protein, 30 aa, Artificial; identical to SEQ ID NO: 566
  Framework region 1

SEQ ID NO: 608 - protein, 30 aa, Artificial; identical to SEQ ID NO: 566
  Framework region 1

SEQ ID NO: 609 - protein, 30 aa, Artificial; identical to SEQ ID NO: 566
  Framework region 1

SEQ ID NO: 610 - protein, 30 aa, Artificial
  Framework region 1
EVQLMESGGGLVQTGGSLRLSCAASGRTFS

SEQ ID NO: 611 - protein, 30 aa, Artificial; identical to SEQ ID NO: 566
  Framework region 1

SEQ ID NO: 612 - protein, 30 aa, Artificial; identical to SEQ ID NO: 566
  Framework region 1

SEQ ID NO: 613 - protein, 30 aa, Artificial
  Framework region 1
AVQLVESGGGLVQTGGSLRLSCAASGRTFS

SEQ ID NO: 614 - protein, 30 aa, Artificial; identical to SEQ ID NO: 566
  Framework region 1

SEQ ID NO: 615 - protein, 30 aa, Artificial; identical to SEQ ID NO: 566
  Framework region 1

SEQ ID NO: 616 - protein, 30 aa, Artificial; identical to SEQ ID NO: 566
  Framework region 1

SEQ ID NO: 617 - protein, 30 aa, Artificial; identical to SEQ ID NO: 566
  Framework region 1

SEQ ID NO: 618 - protein, 30 aa, Artificial
  Framework region 1
EVQLVESRGGLVQTGGSLRLSCAASGRTFS

SEQ ID NO: 619 - protein, 30 aa, Artificial
  Framework region 1
EVQLVESGGGVVQTGGSLRLSCAASGRTFS

SEQ ID NO: 620 - protein, 30 aa, Artificial; identical to SEQ ID NO: 619
  Framework region 1

SEQ ID NO: 621 - protein, 30 aa, Artificial; identical to SEQ ID NO: 619
  Framework region 1

SEQ ID NO: 622 - protein, 30 aa, Artificial
  Framework region 1
EVQLVESRGGLVQPGGSLRLSCAASGRAFN

SEQ ID NO: 623 - protein, 30 aa, Artificial
  Framework region 1
EVQPVESGGGLVQTGGSLRLSCAASGRTFS

SEQ ID NO: 624 - protein, 30 aa, Artificial
  Framework region 1
EVQLVESGGGLVQTGGSLRLSCAASGRAFN

SEQ ID NO: 625 - protein, 30 aa, Artificial; identical to SEQ ID NO: 624
  Framework region 1

SEQ ID NO: 626 - protein, 30 aa, Artificial; identical to SEQ ID NO: 566
  Framework region 1

SEQ ID NO: 627 - protein, 30 aa, Artificial; identical to SEQ ID NO: 624
  Framework region 1

SEQ ID NO: 628 - protein, 30 aa, Artificial
  Framework region 1
EVQLVESGGDLVQPGGSLRLSCAASGRTFS

SEQ ID NO: 629 - protein, 30 aa, Artificial; identical to SEQ ID NO: 566
  Framework region 1

SEQ ID NO: 630 - protein, 30 aa, Artificial
  Framework region 1
EVQLVESGGELVQAGDSLRLSCAASGRTFS

SEQ ID NO: 631 - protein, 30 aa, Artificial; identical to SEQ ID NO: 630
  Framework region 1

SEQ ID NO: 632 - protein, 30 aa, Artificial
  Framework region 1
EVQLVESGGGLVQAGDSLRLSCAASGRTFS

SEQ ID NO: 633 - protein, 30 aa, Artificial; identical to SEQ ID NO: 632
  Framework region 1

SEQ ID NO: 634 - protein, 30 aa, Artificial
  Framework region 1
EVQLVESGGGLVQAGDSLTLSCAASGGTFS

SEQ ID NO: 635 - protein, 30 aa, Artificial; identical to SEQ ID NO: 632
  Framework region 1

SEQ ID NO: 636 - protein, 30 aa, Artificial; identical to SEQ ID NO: 632
  Framework region 1

SEQ ID NO: 637 - protein, 30 aa, Artificial; identical to SEQ ID NO: 632
  Framework region 1

SEQ ID NO: 638 - protein, 30 aa, Artificial
  Framework region 1
EVQLVESGGGLVQAGGSLSLSCAASGRTFS

SEQ ID NO: 639 - protein, 30 aa, Artificial
  Framework region 1
EVQLVESGGGLVQAGGSLGLSCAASGRSFS

SEQ ID NO: 640 - protein, 30 aa, Artificial
  Framework region 1
EVQLVESGGQLVQAGGSLRLSCAATGRTYN

SEQ ID NO: 641 - protein, 30 aa, Artificial
  Framework region 1
EVQLVESGGQLVQAGDSLRLSCVATGRTYN

SEQ ID NO: 642 - protein, 30 aa, Artificial; identical to SEQ ID NO: 640
  Framework region 1

SEQ ID NO: 643 - protein, 30 aa, Artificial
  Framework region 1
EVQLVESGGQLVQAGGSLRLSCTATGHTYN

SEQ ID NO: 644 - protein, 30 aa, Artificial
  Framework region 1
EVQLVESGGQLVQAGGSLRLSCAATGRMYN

SEQ ID NO: 645 - protein, 30 aa, Artificial
  Framework region 1
EVQLVESGGQLVQAGGSLRLSCAATGHTYN

SEQ ID NO: 646 - protein, 30 aa, Artificial; identical to SEQ ID NO: 640
  Framework region 1

SEQ ID NO: 647 - protein, 30 aa, Artificial; identical to SEQ ID NO: 640
  Framework region 1

SEQ ID NO: 648 - protein, 30 aa, Artificial
  Framework region 1
EVQLVKSGGQLVQAGGSLRLSCAATGRTYN

SEQ ID NO: 649 - protein, 30 aa, Artificial
  Framework region 1
EVQLVESGGQLVQAGGSLRLSCTATGHTFN

SEQ ID NO: 650 - protein, 30 aa, Artificial; identical to SEQ ID NO: 640
  Framework region 1

SEQ ID NO: 651 - protein, 30 aa, Artificial; identical to SEQ ID NO: 130
  Framework region 1

SEQ ID NO: 652 - protein, 30 aa, Artificial; identical to SEQ ID NO: 130
  Framework region 1

SEQ ID NO: 653 - protein, 30 aa, Artificial
  Framework region 1
EVQLVESGGGLVQAGGSLRLSCAASGRTNS

SEQ ID NO: 654 - protein, 30 aa, Artificial
  Framework region 1
EVQLVESGGGLVQAGGSLRLSCAAPGRTNS

SEQ ID NO: 655 - protein, 30 aa, Artificial
  Framework region 1
EVQLVESGGGLVQPGGSLRLSCAASGRTNS

SEQ ID NO: 656 - protein, 30 aa, Artificial
  Framework region 1
EVQLVESGGGLVQAGGSLRLSCAASGRMFS

SEQ ID NO: 657 - protein, 30 aa, Artificial
  Framework region 1
EVQLVESGGGLVQAGGSLALSCAASGRMFS

SEQ ID NO: 658 - protein, 30 aa, Artificial; identical to SEQ ID NO: 567
  Framework region 1

SEQ ID NO: 659 - protein, 30 aa, Artificial
  Framework region 1
EVQLVESEGGLVQPGGSLRLSCSASGRTFA

SEQ ID NO: 660 - protein, 30 aa, Artificial
  Framework region 1
KVQLVESGGGLVQAGGSLRLSCSASGRTFA

SEQ ID NO: 661 - protein, 30 aa, Artificial
  Framework region 1
EVQLVESGGGLVKAGDSLRLSCSASGRTFA

SEQ ID NO: 662 - protein, 30 aa, Artificial
  Framework region 1
EVQLVESGGGLVQAGGSLRLSCVASAEGSF

SEQ ID NO: 663 - protein, 29 aa, Artificial
  Framework region 1
EVQLVESGGGLVQAGGSLRLSCAASGRTF

SEQ ID NO: 664 - protein, 5 aa, Artificial
  Complementary determining region 1
IAVAG

SEQ ID NO: 665 - protein, 5 aa, Artificial
  Complementary determining region 1
TATVG

SEQ ID NO: 666 - protein, 5 aa, Artificial
  Complementary determining region 1
SYAMG

SEQ ID NO: 667 - protein, 5 aa, Artificial
  Complementary determining region 1
ISVMA

SEQ ID NO: 668 - protein, 5 aa, Artificial
  Complementary determining region 1
NYAMG

SEQ ID NO: 669 - protein, 5 aa, Artificial
  Complementary determining region 1
YYAIG

SEQ ID NO: 670 - protein, 5 aa, Artificial
  Complementary determining region 1
SYTMG

SEQ ID NO: 671 - protein, 5 aa, Artificial
  Complementary determining region 1
TYIMG

SEQ ID NO: 672 - protein, 5 aa, Artificial
  Complementary determining region 1
YNVMG

SEQ ID NO: 673 - protein, 5 aa, Artificial
  Complementary determining region 1
YNVMG

SEQ ID NO: 674 - protein, 5 aa, Artificial
  Complementary determining region 1
FNVMG

SEQ ID NO: 675 - protein, 5 aa, Artificial
  Complementary determining region 1
FNVMG

SEQ ID NO: 676 - protein, 5 aa, Artificial
  Complementary determining region 1
YYAIG

SEQ ID NO: 677 - protein, 5 aa, Artificial
  Complementary determining region 1
YYAIG

SEQ ID NO: 678 - protein, 5 aa, Artificial
  Complementary determining region 1
YYAIG

SEQ ID NO: 679 - protein, 5 aa, Artificial
  Complementary determining region 1
YYAIG

SEQ ID NO: 680 - protein, 5 aa, Artificial
  Complementary determining region 1
YYAIG

SEQ ID NO: 681 - protein, 5 aa, Artificial
  Complementary determining region 1
YYAIG

SEQ ID NO: 682 - protein, 5 aa, Artificial
  Complementary determining region 1
FYGMG

SEQ ID NO: 683 - protein, 5 aa, Artificial
  Complementary determining region 1
FYGMG

SEQ ID NO: 684 - protein, 5 aa, Artificial
  Complementary determining region 1
FYGMG

SEQ ID NO: 685 - protein, 5 aa, Artificial
  Complementary determining region 1
SYGMG

SEQ ID NO: 686 - protein, 5 aa, Artificial
  Complementary determining region 1
NYAMG

SEQ ID NO: 687 - protein, 5 aa, Artificial
  Complementary determining region 1
NYAMG

SEQ ID NO: 688 - protein, 5 aa, Artificial
  Complementary determining region 1
NYAMG

SEQ ID NO: 689 - protein, 5 aa, Artificial
  Complementary determining region 1
ISTIN

SEQ ID NO: 690 - protein, 5 aa, Artificial
  Complementary determining region 1
INTMG

SEQ ID NO: 691 - protein, 5 aa, Artificial
  Complementary determining region 1
INTMG

SEQ ID NO: 692 - protein, 5 aa, Artificial
  Complementary determining region 1
LNAMG

SEQ ID NO: 693 - protein, 5 aa, Artificial
  Complementary determining region 1
RYIMG

SEQ ID NO: 694 - protein, 5 aa, Artificial
  Complementary determining region 1
RYIMG

SEQ ID NO: 695 - protein, 5 aa, Artificial
  Complementary determining region 1
RYIMG

SEQ ID NO: 696 - protein, 5 aa, Artificial
  Complementary determining region 1
RYIMG

SEQ ID NO: 697 - protein, 5 aa, Artificial
  Complementary determining region 1
RNVMG

SEQ ID NO: 698 - protein, 5 aa, Artificial
  Complementary determining region 1
RNIMG

SEQ ID NO: 699 - protein, 5 aa, Artificial
  Complementary determining region 1
RNVMG

SEQ ID NO: 700 - protein, 5 aa, Artificial
  Complementary determining region 1
RNIMG

SEQ ID NO: 701 - protein, 5 aa, Artificial
  Complementary determining region 1
RNIMG

SEQ ID NO: 702 - protein, 5 aa, Artificial
  Complementary determining region 1
RHIMG

SEQ ID NO: 703 - protein, 5 aa, Artificial
  Complementary determining region 1
RNVMG

SEQ ID NO: 704 - protein, 5 aa, Artificial
  Complementary determining region 1
TATVG

SEQ ID NO: 705 - protein, 5 aa, Artificial
  Complementary determining region 1
HYAMA

SEQ ID NO: 706 - protein, 5 aa, Artificial
  Complementary determining region 1
RYIMA

SEQ ID NO: 707 - protein, 5 aa, Artificial
  Complementary determining region 1
NYTMG

SEQ ID NO: 708 - protein, 5 aa, Artificial
  Complementary determining region 1
NYTMG

SEQ ID NO: 709 - protein, 5 aa, Artificial
  Complementary determining region 1
NYTMG

SEQ ID NO: 710 - protein, 5 aa, Artificial
  Complementary determining region 1
NYTMG

SEQ ID NO: 711 - protein, 5 aa, Artificial
  Complementary determining region 1
NYTMG

SEQ ID NO: 712 - protein, 5 aa, Artificial
  Complementary determining region 1
NYTMG

SEQ ID NO: 713 - protein, 5 aa, Artificial
  Complementary determining region 1
SYTMG

SEQ ID NO: 714 - protein, 5 aa, Artificial
  Complementary determining region 1
NYTMG

SEQ ID NO: 715 - protein, 5 aa, Artificial
  Complementary determining region 1
NYTMG

SEQ ID NO: 716 - protein, 5 aa, Artificial
  Complementary determining region 1
NYTMG

SEQ ID NO: 717 - protein, 5 aa, Artificial
  Complementary determining region 1
SYTMG

SEQ ID NO: 718 - protein, 5 aa, Artificial
  Complementary determining region 1
SYTMG

SEQ ID NO: 719 - protein, 5 aa, Artificial
  Complementary determining region 1
NYTMG

SEQ ID NO: 720 - protein, 5 aa, Artificial
  Complementary determining region 1
SYTTG

SEQ ID NO: 721 - protein, 5 aa, Artificial
  Complementary determining region 1
NYTMG

SEQ ID NO: 722 - protein, 5 aa, Artificial
  Complementary determining region 1
NYTMG

SEQ ID NO: 723 - protein, 5 aa, Artificial
  Complementary determining region 1
MYTMG

SEQ ID NO: 724 - protein, 5 aa, Artificial
  Complementary determining region 1
MYTMG

SEQ ID NO: 725 - protein, 5 aa, Artificial
  Complementary determining region 1
MYTMG

SEQ ID NO: 726 - protein, 5 aa, Artificial
  Complementary determining region 1
NYTMG

SEQ ID NO: 727 - protein, 5 aa, Artificial
  Complementary determining region 1
NYTMG

SEQ ID NO: 728 - protein, 5 aa, Artificial
  Complementary determining region 1
NYTMG

SEQ ID NO: 729 - protein, 5 aa, Artificial
  Complementary determining region 1
NYTMG

SEQ ID NO: 730 - protein, 5 aa, Artificial
  Complementary determining region 1
SYTMG

SEQ ID NO: 731 - protein, 5 aa, Artificial
  Complementary determining region 1
NYTMG

SEQ ID NO: 732 - protein, 5 aa, Artificial
  Complementary determining region 1
NYTVG

SEQ ID NO: 733 - protein, 5 aa, Artificial
  Complementary determining region 1
NYTVG

SEQ ID NO: 734 - protein, 5 aa, Artificial
  Complementary determining region 1
SYIMG

SEQ ID NO: 735 - protein, 5 aa, Artificial
  Complementary determining region 1
SYIMG

SEQ ID NO: 736 - protein, 5 aa, Artificial
  Complementary determining region 1
SYIMG

SEQ ID NO: 737 - protein, 5 aa, Artificial
  Complementary determining region 1
SYIMG

SEQ ID NO: 738 - protein, 5 aa, Artificial
  Complementary determining region 1
TYVMG

SEQ ID NO: 739 - protein, 5 aa, Artificial
  Complementary determining region 1
SYVMG

SEQ ID NO: 740 - protein, 5 aa, Artificial
  Complementary determining region 1
NYVMG

SEQ ID NO: 741 - protein, 5 aa, Artificial
  Complementary determining region 1
SYVMG

SEQ ID NO: 742 - protein, 5 aa, Artificial
  Complementary determining region 1
SITMA

SEQ ID NO: 743 - protein, 5 aa, Artificial
  Complementary determining region 1
MYAMG

SEQ ID NO: 744 - protein, 5 aa, Artificial
  Complementary determining region 1
SYSLG

SEQ ID NO: 745 - protein, 5 aa, Artificial
  Complementary determining region 1
SYSLG

SEQ ID NO: 746 - protein, 5 aa, Artificial
  Complementary determining region 1
SYSLG

SEQ ID NO: 747 - protein, 5 aa, Artificial
  Complementary determining region 1
TYPLG

SEQ ID NO: 748 - protein, 5 aa, Artificial
  Complementary determining region 1
SYSLG

SEQ ID NO: 749 - protein, 5 aa, Artificial
  Complementary determining region 1
TYPLG

SEQ ID NO: 750 - protein, 5 aa, Artificial
  Complementary determining region 1
SYPLG

SEQ ID NO: 751 - protein, 5 aa, Artificial
  Complementary determining region 1
SYSLG

SEQ ID NO: 752 - protein, 5 aa, Artificial
  Complementary determining region 1
SYPLG

SEQ ID NO: 753 - protein, 5 aa, Artificial
  Complementary determining region 1
TYPLA

SEQ ID NO: 754 - protein, 5 aa, Artificial
  Complementary determining region 1
SYPLG

SEQ ID NO: 755 - protein, 5 aa, Artificial
  Complementary determining region 1
NTLMG

SEQ ID NO: 756 - protein, 5 aa, Artificial
  Complementary determining region 1
NTLMG

SEQ ID NO: 757 - protein, 5 aa, Artificial
  Complementary determining region 1
TTLMG

SEQ ID NO: 758 - protein, 5 aa, Artificial
  Complementary determining region 1
TTLMG

SEQ ID NO: 759 - protein, 5 aa, Artificial
  Complementary determining region 1
TTLMG

SEQ ID NO: 760 - protein, 5 aa, Artificial
  Complementary determining region 1
SRSIG

SEQ ID NO: 761 - protein, 5 aa, Artificial
  Complementary determining region 1
SRSIG

SEQ ID NO: 762 - protein, 5 aa, Artificial
  Complementary determining region 1
TYIMG

SEQ ID NO: 763 - protein, 5 aa, Artificial
  Complementary determining region 1
NNAMG

SEQ ID NO: 764 - protein, 5 aa, Artificial
  Complementary determining region 1
NNAMG

SEQ ID NO: 765 - protein, 5 aa, Artificial
  Complementary determining region 1
NNAMG

SEQ ID NO: 766 - protein, 6 aa, Artificial
  Complementary determining region 1
STYVMA

SEQ ID NO: 767 - protein, 6 aa, Artificial
  Complementary determining region 1
SNYTIA

SEQ ID NO: 768 - protein, 14 aa, Artificial
  Framework region 2
WYRRQPGKERELVA

SEQ ID NO: 769 - protein, 14 aa, Artificial
  Framework region 2
WFRQAPGKEREFVA

SEQ ID NO: 770 - protein, 14 aa, Artificial
  Framework region 2
WFRQAPGKEREFVA

SEQ ID NO: 771 - protein, 14 aa, Artificial
  Framework region 2
WYRQAPGKQRELVA

SEQ ID NO: 772 - protein, 14 aa, Artificial
  Framework region 2
WFRQAPGKGREFVA

SEQ ID NO: 773 - protein, 14 aa, Artificial
  Framework region 2
WFRQAPGKEREGVS

SEQ ID NO: 774 - protein, 14 aa, Artificial
  Framework region 2
WFRQAPGKDREFVA

SEQ ID NO: 775 - protein, 14 aa, Artificial
  Framework region 2
WFRQAPGKEREFVA

SEQ ID NO: 776 - protein, 14 aa, Artificial
  Framework region 2
WYRQAPGQQRDLVA

SEQ ID NO: 777 - protein, 14 aa, Artificial
  Framework region 2
WYRQAPGQQRDLVA

SEQ ID NO: 778 - protein, 14 aa, Artificial
  Framework region 2
WYRQAPGQQRDLVA

SEQ ID NO: 779 - protein, 14 aa, Artificial
  Framework region 2
WYRQAPGKQRDLVA

SEQ ID NO: 780 - protein, 14 aa, Artificial
  Framework region 2
WFRQAPGKEREGVS

SEQ ID NO: 781 - protein, 14 aa, Artificial
  Framework region 2
WFRQAPGKEREGVS

SEQ ID NO: 782 - protein, 14 aa, Artificial
  Framework region 2
WFRQAPGKEREGVS

SEQ ID NO: 783 - protein, 14 aa, Artificial
  Framework region 2
WFRQAPGKEREGVS

SEQ ID NO: 784 - protein, 14 aa, Artificial
  Framework region 2
WFRQAPGKEREGVS

SEQ ID NO: 785 - protein, 14 aa, Artificial
  Framework region 2
WFRQAPGKEREGVS

SEQ ID NO: 786 - protein, 14 aa, Artificial
  Framework region 2
WFRQAPGKEQEFVA

SEQ ID NO: 787 - protein, 14 aa, Artificial
  Framework region 2
WFRQAPGKEQEFVA

SEQ ID NO: 788 - protein, 14 aa, Artificial
  Framework region 2
WFRQAPGKEREFVA

SEQ ID NO: 789 - protein, 14 aa, Artificial
  Framework region 2
WFRQAPGKEREFVA

SEQ ID NO: 790 - protein, 14 aa, Artificial
  Framework region 2
WFRQAPGKGREFVA

SEQ ID NO: 791 - protein, 14 aa, Artificial
  Framework region 2
WFRQAPGKGREFVA

SEQ ID NO: 792 - protein, 14 aa, Artificial
  Framework region 2
WFRQAPGKGREFVA

SEQ ID NO: 793 - protein, 14 aa, Artificial
  Framework region 2
WYRQAPGKQRESVA

SEQ ID NO: 794 - protein, 14 aa, Artificial
  Framework region 2
WYRQAPGKQRELVA

SEQ ID NO: 795 - protein, 14 aa, Artificial
  Framework region 2
WYRQAPGKQRELVA

SEQ ID NO: 796 - protein, 14 aa, Artificial
  Framework region 2
WYRQAPGKQRELVA

SEQ ID NO: 797 - protein, 14 aa, Artificial
  Framework region 2
WYRQAPGKQRELVA

SEQ ID NO: 798 - protein, 14 aa, Artificial
  Framework region 2
WYRQAPGKERELVA

SEQ ID NO: 799 - protein, 14 aa, Artificial
  Framework region 2
WYRQAPGKQRELVA

SEQ ID NO: 800 - protein, 14 aa, Artificial
  Framework region 2
WYRQAPGKQRESVA

SEQ ID NO: 801 - protein, 14 aa, Artificial
  Framework region 2
WYRQAPGKQRDLVA

SEQ ID NO: 802 - protein, 14 aa, Artificial
  Framework region 2
WYRQAPGNQRDLVA

SEQ ID NO: 803 - protein, 14 aa, Artificial
  Framework region 2
WYRQAPGNQRDLVA

SEQ ID NO: 804 - protein, 14 aa, Artificial
  Framework region 2
WYRQAPGKQRDLVA

SEQ ID NO: 805 - protein, 14 aa, Artificial
  Framework region 2
WYRQAPGKQRDLVA

SEQ ID NO: 806 - protein, 14 aa, Artificial
  Framework region 2
WYRQAPGKQRELVA

SEQ ID NO: 807 - protein, 14 aa, Artificial
  Framework region 2
WYRQAPGKQRDLVA

SEQ ID NO: 808 - protein, 14 aa, Artificial
  Framework region 2
WFRQAPGKEREFVA

SEQ ID NO: 809 - protein, 14 aa, Artificial
  Framework region 2
WFRRPPGNEREFVA

SEQ ID NO: 810 - protein, 14 aa, Artificial
  Framework region 2
WFRQAPGKEREFVA

SEQ ID NO: 811 - protein, 14 aa, Artificial
  Framework region 2
WFRQAPGKDREFVA

SEQ ID NO: 812 - protein, 14 aa, Artificial
  Framework region 2
WFRQAPGKDREFVA

SEQ ID NO: 813 - protein, 14 aa, Artificial
  Framework region 2
WFRQAPGKDREFVA

SEQ ID NO: 814 - protein, 14 aa, Artificial
  Framework region 2
WFRQAPGKDREFVA

SEQ ID NO: 815 - protein, 14 aa, Artificial
  Framework region 2
WFRQAPGKDREFVA

SEQ ID NO: 816 - protein, 14 aa, Artificial
  Framework region 2
WFRQAPGKDREFVA

SEQ ID NO: 817 - protein, 14 aa, Artificial
  Framework region 2
WFRQAPGKDREFVT

SEQ ID NO: 818 - protein, 14 aa, Artificial
  Framework region 2
WFRQAPGKDREFVA

SEQ ID NO: 819 - protein, 14 aa, Artificial
  Framework region 2
WFRQAPGKDREFVA

SEQ ID NO: 820 - protein, 14 aa, Artificial
  Framework region 2
WFRQAPGKDREFVA

SEQ ID NO: 821 - protein, 14 aa, Artificial
  Framework region 2
WFRQAPGKDREYVA

SEQ ID NO: 822 - protein, 14 aa, Artificial
  Framework region 2
WFRQAPGKDREYVA

SEQ ID NO: 823 - protein, 14 aa, Artificial
  Framework region 2
WFRQAPGKDREFVA

SEQ ID NO: 824 - protein, 14 aa, Artificial
  Framework region 2
WFRQAPGKDREFVA

SEQ ID NO: 825 - protein, 14 aa, Artificial
  Framework region 2
WFRQAPGKDREFVA

SEQ ID NO: 826 - protein, 14 aa, Artificial
  Framework region 2
WFRQAPGKDREFVA

SEQ ID NO: 827 - protein, 14 aa, Artificial
  Framework region 2
WFRRAPGKDREFVA

SEQ ID NO: 828 - protein, 14 aa, Artificial
  Framework region 2
WFRQAPGEDREFVA

SEQ ID NO: 829 - protein, 14 aa, Artificial
  Framework region 2
WFRQAPGKDREFVA

SEQ ID NO: 830 - protein, 14 aa, Artificial
  Framework region 2
WFRQAPGKDREFVA

SEQ ID NO: 831 - protein, 14 aa, Artificial
  Framework region 2
WFRQAPGKDREFVA

SEQ ID NO: 832 - protein, 14 aa, Artificial
  Framework region 2
WFRQAPGKDREFVA

SEQ ID NO: 833 - protein, 14 aa, Artificial
  Framework region 2
WFRQAPGKDREFVA

SEQ ID NO: 834 - protein, 14 aa, Artificial
  Framework region 2
WFRQAPGKDREFVA

SEQ ID NO: 835 - protein, 14 aa, Artificial
  Framework region 2
WFRQAPGKDREFVA

SEQ ID NO: 836 - protein, 14 aa, Artificial
  Framework region 2
WFRQAPGKDREFVT

SEQ ID NO: 837 - protein, 14 aa, Artificial
  Framework region 2
WFRQAPGKDREFVT

SEQ ID NO: 838 - protein, 14 aa, Artificial
  Framework region 2
WFRQAPGKEREFVA

SEQ ID NO: 839 - protein, 14 aa, Artificial
  Framework region 2
WFRQAPGKEREFVA

SEQ ID NO: 840 - protein, 14 aa, Artificial
  Framework region 2
WFRQAPGKEREFVA

SEQ ID NO: 841 - protein, 14 aa, Artificial
  Framework region 2
WFRRAPGKEREFVA

SEQ ID NO: 842 - protein, 14 aa, Artificial
  Framework region 2
WFRQASGKEREFVA

SEQ ID NO: 843 - protein, 14 aa, Artificial
  Framework region 2
WFRQAPGKEREFVA

SEQ ID NO: 844 - protein, 14 aa, Artificial
  Framework region 2
WFRQAPGKEREFVS

SEQ ID NO: 845 - protein, 14 aa, Artificial
  Framework region 2
WFRQAPGKEREFVA

SEQ ID NO: 846 - protein, 14 aa, Artificial
  Framework region 2
WFRQTPGKEREFVA

SEQ ID NO: 847 - protein, 14 aa, Artificial
  Framework region 2
WFRTAPGKEREFVA

SEQ ID NO: 848 - protein, 14 aa, Artificial
  Framework region 2
WSRQAPGKEREFVA

SEQ ID NO: 849 - protein, 14 aa, Artificial
  Framework region 2
WSRQAPGKEREFVA

SEQ ID NO: 850 - protein, 14 aa, Artificial
  Framework region 2
WSRQAPGKEREFVA

SEQ ID NO: 851 - protein, 14 aa, Artificial
  Framework region 2
WFRQAPGKEREFVA

SEQ ID NO: 852 - protein, 14 aa, Artificial
  Framework region 2
WSRQAPGKEREFVA

SEQ ID NO: 853 - protein, 14 aa, Artificial
  Framework region 2
WFRQAPGKEREFVA

SEQ ID NO: 854 - protein, 14 aa, Artificial
  Framework region 2
WFRQAPGKEREFVA

SEQ ID NO: 855 - protein, 14 aa, Artificial
  Framework region 2
WFRQAPGKEHEFVA

SEQ ID NO: 856 - protein, 14 aa, Artificial
  Framework region 2
WFRQAPGKEREFVA

SEQ ID NO: 857 - protein, 14 aa, Artificial
  Framework region 2
WFRQAPWKEREFVA

SEQ ID NO: 858 - protein, 14 aa, Artificial
  Framework region 2
WFRQAPGKEREFVA

SEQ ID NO: 859 - protein, 14 aa, Artificial
  Framework region 2
WSRRAPGKEREFVA

SEQ ID NO: 860 - protein, 14 aa, Artificial
  Framework region 2
WSRRAPGKEREFVA

SEQ ID NO: 861 - protein, 14 aa, Artificial
  Framework region 2
WSRRAPGKEREFVA

SEQ ID NO: 862 - protein, 14 aa, Artificial
  Framework region 2
WSRRAPGKEREFVA

SEQ ID NO: 863 - protein, 14 aa, Artificial
  Framework region 2
WSRRAPGKEREFVA

SEQ ID NO: 864 - protein, 14 aa, Artificial
  Framework region 2
WFRQVPGKEREFVA

SEQ ID NO: 865 - protein, 14 aa, Artificial
  Framework region 2
WFRQAPGKDREFVA

SEQ ID NO: 866 - protein, 14 aa, Artificial
  Framework region 2
WFRQAPGKEREFVA

SEQ ID NO: 867 - protein, 14 aa, Artificial
  Framework region 2
WFRQAPGKEREFVA

SEQ ID NO: 868 - protein, 14 aa, Artificial
  Framework region 2
WFRQAPGKEREFVA

SEQ ID NO: 869 - protein, 14 aa, Artificial
  Framework region 2
WFRQAPGKEREFVA

SEQ ID NO: 870 - protein, 14 aa, Artificial
  Framework region 2
WFRQAPGKEREFAA

SEQ ID NO: 871 - protein, 14 aa, Artificial
  Framework region 2
YFRQAPGREREFAA

SEQ ID NO: 872 - protein, 16 aa, Artificial
  Complementary determining region 2
TISPGNNTHYVDSVKG

SEQ ID NO: 873 - protein, 17 aa, Artificial
  Complementary determining region 2
VINWRSGFTYYADSVKG

SEQ ID NO: 874 - protein, 16 aa, Artificial
  Complementary determining region 2
AISPSGLTSYKDSVVG

SEQ ID NO: 875 - protein, 16 aa, Artificial
  Complementary determining region 2
RITPGGNTNYVDSVQG

SEQ ID NO: 876 - protein, 17 aa, Artificial
  Complementary determining region 2
DIRWSDGRTYYADSVKG

SEQ ID NO: 877 - protein, 17 aa, Artificial
  Complementary determining region 2
CIDSSDGSTYYADSVKG

SEQ ID NO: 878 - protein, 17 aa, Artificial
  Complementary determining region 2
AISRSGSLTSYADSVKG

SEQ ID NO: 879 - protein, 17 aa, Artificial
  Complementary determining region 2
ATSPSGTLTSYADSVKG

SEQ ID NO: 880 - protein, 16 aa, Artificial
  Complementary determining region 2
HIASNGEIMYADSAKG

SEQ ID NO: 881 - protein, 16 aa, Artificial
  Complementary determining region 2
HIASNGEIMYADSAKG

SEQ ID NO: 882 - protein, 16 aa, Artificial
  Complementary determining region 2
HIASNGEIMYADSVKG

SEQ ID NO: 883 - protein, 16 aa, Artificial
  Complementary determining region 2
HIASGGEIMYTDSVKG

SEQ ID NO: 884 - protein, 17 aa, Artificial
  Complementary determining region 2
CIVGSDGSTYYADSVKG

SEQ ID NO: 885 - protein, 17 aa, Artificial
  Complementary determining region 2
CIDSSDGSTYYADSVKG

SEQ ID NO: 886 - protein, 17 aa, Artificial
  Complementary determining region 2
CISLSDGSTYYADSVKG

SEQ ID NO: 887 - protein, 17 aa, Artificial
  Complementary determining region 2
CIVSSDGSTYYADSVKS

SEQ ID NO: 888 - protein, 17 aa, Artificial
  Complementary determining region 2
CITISDGDTYYADSVKG

SEQ ID NO: 889 - protein, 17 aa, Artificial
  Complementary determining region 2
CITISDGDTYYADSVKG

SEQ ID NO: 890 - protein, 17 aa, Artificial
  Complementary determining region 2
DIRTSAGRTYYADSVKG

SEQ ID NO: 891 - protein, 17 aa, Artificial
  Complementary determining region 2
DIRTSAGRTYYADSVKG

SEQ ID NO: 892 - protein, 17 aa, Artificial
  Complementary determining region 2
DIRTSAGRTYYADSVKG

SEQ ID NO: 893 - protein, 17 aa, Artificial
  Complementary determining region 2
DIRSSAGRTYYAGSVKG

SEQ ID NO: 894 - protein, 17 aa, Artificial
  Complementary determining region 2
DIRWSDGRTYYADSVKG

SEQ ID NO: 895 - protein, 17 aa, Artificial
  Complementary determining region 2
DIRWSDGRTYYADSVKG

SEQ ID NO: 896 - protein, 17 aa, Artificial
  Complementary determining region 2
DIRWSDGRTYYADSVKG

SEQ ID NO: 897 - protein, 16 aa, Artificial
  Complementary determining region 2
AITGTSVTGYADSVKG

SEQ ID NO: 898 - protein, 16 aa, Artificial
  Complementary determining region 2
TITSSGSTNYADSVKG

SEQ ID NO: 899 - protein, 16 aa, Artificial
  Complementary determining region 2
AITSGGSTNYADSVKG

SEQ ID NO: 900 - protein, 16 aa, Artificial
  Complementary determining region 2
AITSGGSTNYADSVKG

SEQ ID NO: 901 - protein, 16 aa, Artificial
  Complementary determining region 2
DITPGGNTNYADSVKG

SEQ ID NO: 902 - protein, 16 aa, Artificial
  Complementary determining region 2
DITPGGNTNYANSVKG

SEQ ID NO: 903 - protein, 16 aa, Artificial
  Complementary determining region 2
DITPGGNTNYADSVKG

SEQ ID NO: 904 - protein, 16 aa, Artificial
  Complementary determining region 2
TITPGGNTDYADSVKG

SEQ ID NO: 905 - protein, 16 aa, Artificial
  Complementary determining region 2
SITPGGNIYYADSVKG

SEQ ID NO: 906 - protein, 16 aa, Artificial
  Complementary determining region 2
SITPGGNMYYADSVKG

SEQ ID NO: 907 - protein, 16 aa, Artificial
  Complementary determining region 2
SITPGGNIYYADSVKG

SEQ ID NO: 908 - protein, 16 aa, Artificial
  Complementary determining region 2
SITPGGNMYYADSVKG

SEQ ID NO: 909 - protein, 16 aa, Artificial
  Complementary determining region 2
SITPGGNINYADSVKG

SEQ ID NO: 910 - protein, 16 aa, Artificial
  Complementary determining region 2
SITPGDNINYADSVKG

SEQ ID NO: 911 - protein, 16 aa, Artificial
  Complementary determining region 2
SITPGGNINYADSVKG

SEQ ID NO: 912 - protein, 17 aa, Artificial
  Complementary determining region 2
VINWRSGFTYYADSVKG

SEQ ID NO: 913 - protein, 16 aa, Artificial
  Complementary determining region 2
GIGWTYTTFYADSVKG

SEQ ID NO: 914 - protein, 17 aa, Artificial
  Complementary determining region 2
VIDGSGYSTDYAGSVKG

SEQ ID NO: 915 - protein, 17 aa, Artificial
  Complementary determining region 2
AISRSGSLKSYADSVKG

SEQ ID NO: 916 - protein, 17 aa, Artificial
  Complementary determining region 2
AISRSGNLKSYADSVKG

SEQ ID NO: 917 - protein, 17 aa, Artificial
  Complementary determining region 2
AISRSGSLKSYADSVKG

SEQ ID NO: 918 - protein, 17 aa, Artificial
  Complementary determining region 2
AISRSGGLKSYADSVKG

SEQ ID NO: 919 - protein, 17 aa, Artificial
  Complementary determining region 2
AISRSGALKAYADSVKG

SEQ ID NO: 920 - protein, 17 aa, Artificial
  Complementary determining region 2
AISRSGSLKAYADSVKG

SEQ ID NO: 921 - protein, 17 aa, Artificial
  Complementary determining region 2
AISRSGTLTSYADSVKG

SEQ ID NO: 922 - protein, 17 aa, Artificial
  Complementary determining region 2
AISRSGSLKAYADSVKG

SEQ ID NO: 923 - protein, 17 aa, Artificial
  Complementary determining region 2
AISRSGSLKSYADSVNG

SEQ ID NO: 924 - protein, 17 aa, Artificial
  Complementary determining region 2
AISRSGNLKSYADSVNG

SEQ ID NO: 925 - protein, 17 aa, Artificial
  Complementary determining region 2
AISRSGSLKGYADSVKG

SEQ ID NO: 926 - protein, 17 aa, Artificial
  Complementary determining region 2
AISRSGSLKGYADSVKG

SEQ ID NO: 927 - protein, 17 aa, Artificial
  Complementary determining region 2
AISRSGTLKAYADSVKG

SEQ ID NO: 928 - protein, 17 aa, Artificial
  Complementary determining region 2
AISRSGSLTSYADSVKG

SEQ ID NO: 929 - protein, 17 aa, Artificial
  Complementary determining region 2
AISRSGSLKAYADSVKG

SEQ ID NO: 930 - protein, 17 aa, Artificial
  Complementary determining region 2
AISRSGSLKSYADSVKG

SEQ ID NO: 931 - protein, 17 aa, Artificial
  Complementary determining region 2
AISRSGGLKAYADSVLG

SEQ ID NO: 932 - protein, 17 aa, Artificial
  Complementary determining region 2
AISRSGGLKAYADSVLG

SEQ ID NO: 933 - protein, 17 aa, Artificial
  Complementary determining region 2
AISRSGGLKAYADSVLG

SEQ ID NO: 934 - protein, 17 aa, Artificial
  Complementary determining region 2
AISRSGNLKAYADSVNG

SEQ ID NO: 935 - protein, 17 aa, Artificial
  Complementary determining region 2
AISRSGNLKAYADSVKG

SEQ ID NO: 936 - protein, 17 aa, Artificial
  Complementary determining region 2
AISRSGNLKAYADSVNG

SEQ ID NO: 937 - protein, 17 aa, Artificial
  Complementary determining region 2
AISRSGNLKAYADSVNG

SEQ ID NO: 938 - protein, 17 aa, Artificial
  Complementary determining region 2
AISRSGGLTSYADSVKG

SEQ ID NO: 939 - protein, 17 aa, Artificial
  Complementary determining region 2
AISRSGNLKAYADSVNG

SEQ ID NO: 940 - protein, 17 aa, Artificial
  Complementary determining region 2
AISRSGSLKAYADSVKD

SEQ ID NO: 941 - protein, 17 aa, Artificial
  Complementary determining region 2
AISRSGSLKAYADSVKD

SEQ ID NO: 942 - protein, 17 aa, Artificial
  Complementary determining region 2
AISPSGALTSYADSVKG

SEQ ID NO: 943 - protein, 17 aa, Artificial
  Complementary determining region 2
AISPSGALTSYADSVKG

SEQ ID NO: 944 - protein, 17 aa, Artificial
  Complementary determining region 2
AISSSGALTSYADSVKG

SEQ ID NO: 945 - protein, 17 aa, Artificial
  Complementary determining region 2
AISSSGALTSYADSVVG

SEQ ID NO: 946 - protein, 17 aa, Artificial
  Complementary determining region 2
AISPSGTLTSYADSVKG

SEQ ID NO: 947 - protein, 17 aa, Artificial
  Complementary determining region 2
AISSSGALTSYADSVYG

SEQ ID NO: 948 - protein, 17 aa, Artificial
  Complementary determining region 2
AISPSGTLTSYTDSVKG

SEQ ID NO: 949 - protein, 17 aa, Artificial
  Complementary determining region 2
AISPSGSLTSYADSVKG

SEQ ID NO: 950 - protein, 17 aa, Artificial
  Complementary determining region 2
AISRSGSLTSYADSLKG

SEQ ID NO: 951 - protein, 17 aa, Artificial
  Complementary determining region 2
AISGSGTLTSYADSVKG

SEQ ID NO: 952 - protein, 17 aa, Artificial
  Complementary determining region 2
AISASGTLRAYADSVKG

SEQ ID NO: 953 - protein, 17 aa, Artificial
  Complementary determining region 2
AISASGTLRAYADSVKG

SEQ ID NO: 954 - protein, 17 aa, Artificial
  Complementary determining region 2
AISASGTLRAYADSVKG

SEQ ID NO: 955 - protein, 17 aa, Artificial
  Complementary determining region 2
AISPSGTLRAYADSVKG

SEQ ID NO: 956 - protein, 17 aa, Artificial
  Complementary determining region 2
AISASGTLRAYADSVKG

SEQ ID NO: 957 - protein, 17 aa, Artificial
  Complementary determining region 2
AISPSGTLRAYADSVKG

SEQ ID NO: 958 - protein, 17 aa, Artificial
  Complementary determining region 2
AISASGTLRAYADSVKG

SEQ ID NO: 959 - protein, 17 aa, Artificial
  Complementary determining region 2
AISASGTLRAYADSVKG

SEQ ID NO: 960 - protein, 17 aa, Artificial
  Complementary determining region 2
AISASGTLRAYADSVKG

SEQ ID NO: 961 - protein, 17 aa, Artificial
  Complementary determining region 2
AISPSGTLRAYADSVKG

SEQ ID NO: 962 - protein, 17 aa, Artificial
  Complementary determining region 2
AISASGTLRAYADSVKG

SEQ ID NO: 963 - protein, 17 aa, Artificial
  Complementary determining region 2
AISGSGTLTSYADSVKG

SEQ ID NO: 964 - protein, 17 aa, Artificial
  Complementary determining region 2
AISGSGTLTSYADSVKG

SEQ ID NO: 965 - protein, 17 aa, Artificial
  Complementary determining region 2
AISGSGTLTSYADSVKG

SEQ ID NO: 966 - protein, 17 aa, Artificial
  Complementary determining region 2
AISGSGTLTSYADSVKG

SEQ ID NO: 967 - protein, 17 aa, Artificial
  Complementary determining region 2
AISGSGTLTSYADSVKG

SEQ ID NO: 968 - protein, 17 aa, Artificial
  Complementary determining region 2
AISPSRSLKAYADSVKG

SEQ ID NO: 969 - protein, 17 aa, Artificial
  Complementary determining region 2
AISPSGSLKAYADSVKG

SEQ ID NO: 970 - protein, 17 aa, Artificial
  Complementary determining region 2
ATSPSGTLTSYADSVKG

SEQ ID NO: 971 - protein, 17 aa, Artificial
  Complementary determining region 2
SISASGTLTSSADSVKG

SEQ ID NO: 972 - protein, 17 aa, Artificial
  Complementary determining region 2
SLSASGSLTSYADSVNG

SEQ ID NO: 973 - protein, 17 aa, Artificial
  Complementary determining region 2
SISASGTLTSSADSVRG

SEQ ID NO: 974 - protein, 17 aa, Artificial
  Complementary determining region 2
AISGRSGLTSYADSVKG

SEQ ID NO: 975 - protein, 17 aa, Artificial
  Complementary determining region 2
AISPHGTLRSFADSVKD

SEQ ID NO: 976 - protein, 32 aa, Artificial
  Framework region 3
RFTISRDNAKNTVYLQMTTLKPDDTAAYYCNA

SEQ ID NO: 977 - protein, 32 aa, Artificial
  Framework region 3
RFTISREYAKNTVYLQMDSLKPEDTAVYSCAA

SEQ ID NO: 978 - protein, 32 aa, Artificial
  Framework region 3
RFTISRDNAKNTVYLQMNSLKPEDTAVHYCAA

SEQ ID NO: 979 - protein, 32 aa, Artificial; identical to SEQ ID NO: 218
  Framework region 3

SEQ ID NO: 980 - protein, 32 aa, Artificial
  Framework region 3
RFTVSRDNAKNTVYLQMNSLKPEDTAVYYCAA

SEQ ID NO: 981 - protein, 32 aa, Artificial; identical to SEQ ID NO: 112
  Framework region 3

SEQ ID NO: 982 - protein, 32 aa, Artificial
  Framework region 3
RFTISRDNAKKMAYLQMNSLKPEDTAVYYCAA

SEQ ID NO: 983 - protein, 32 aa, Artificial
  Framework region 3
RFSMSRDNAKKMVDLQMNSLKPEDTAVYYCAA

SEQ ID NO: 984 - protein, 32 aa, Artificial
  Framework region 3
RFTISRDNAKKTVYLQMNSLKPEDTAVYYCKL

SEQ ID NO: 985 - protein, 32 aa, Artificial; identical to SEQ ID NO: 984
  Framework region 3

SEQ ID NO: 986 - protein, 32 aa, Artificial; identical to SEQ ID NO: 984
  Framework region 3

SEQ ID NO: 987 - protein, 32 aa, Artificial; identical to SEQ ID NO: 984
  Framework region 3

SEQ ID NO: 988 - protein, 32 aa, Artificial; identical to SEQ ID NO: 112
  Framework region 3

SEQ ID NO: 989 - protein, 32 aa, Artificial; identical to SEQ ID NO: 112
  Framework region 3

SEQ ID NO: 990 - protein, 32 aa, Artificial; identical to SEQ ID NO: 112
  Framework region 3

SEQ ID NO: 991 - protein, 32 aa, Artificial
  Framework region 3
RFTISRDNAKNTVYLHMNSLKPEDTAVYYCAA

SEQ ID NO: 992 - protein, 32 aa, Artificial
  Framework region 3
RFTISRDNANNTVNLQMNSLKPEDTAVYYCAA

SEQ ID NO: 993 - protein, 32 aa, Artificial
  Framework region 3
RFTIARDYAKNTVYLQMNSLKPEDTAVYYCAA

SEQ ID NO: 994 - protein, 32 aa, Artificial; identical to SEQ ID NO: 112
  Framework region 3

SEQ ID NO: 995 - protein, 32 aa, Artificial; identical to SEQ ID NO: 112
  Framework region 3

SEQ ID NO: 996 - protein, 32 aa, Artificial; identical to SEQ ID NO: 112
  Framework region 3

SEQ ID NO: 997 - protein, 32 aa, Artificial; identical to SEQ ID NO: 112
  Framework region 3

SEQ ID NO: 998 - protein, 32 aa, Artificial; identical to SEQ ID NO: 980
  Framework region 3

SEQ ID NO: 999 - protein, 32 aa, Artificial; identical to SEQ ID NO: 980
  Framework region 3

SEQ ID NO: 1000 - protein, 32 aa, Artificial; identical to SEQ ID NO: 980
  Framework region 3

SEQ ID NO: 1001 - protein, 32 aa, Artificial
  Framework region 3
RFTLSRDNAKNTVYLQMDNLKPEDTAVYYCNV

SEQ ID NO: 1002 - protein, 32 aa, Artificial; identical to SEQ ID NO: 218
  Framework region 3

SEQ ID NO: 1003 - protein, 32 aa, Artificial; identical to SEQ ID NO: 218
  Framework region 3

SEQ ID NO: 1004 - protein, 32 aa, Artificial; identical to SEQ ID NO: 218
  Framework region 3

SEQ ID NO: 1005 - protein, 32 aa, Artificial
  Framework region 3
RFTISRDGAKNTVGLQMNSLRPEDTAVYSCYA

SEQ ID NO: 1006 - protein, 32 aa, Artificial
  Framework region 3
RFTISRDGAKNTVGLQMNSLRPDDTAVYSCYA

SEQ ID NO: 1007 - protein, 32 aa, Artificial
  Framework region 3
RFSISRDGAKNTVDLQMNSLRPEDTAVYYCNA

SEQ ID NO: 1008 - protein, 32 aa, Artificial
  Framework region 3
RFTISRDGAKNTVDLQMNSLKPEDTAVYYCNA

SEQ ID NO: 1009 - protein, 32 aa, Artificial
  Framework region 3
RFTISRDGAKNTVYLQMNSLKPEDTAVYYCNA

SEQ ID NO: 1010 - protein, 32 aa, Artificial; identical to SEQ ID NO: 1009
  Framework region 3

SEQ ID NO: 1011 - protein, 32 aa, Artificial
  Framework region 3
RFTISRDGAKSTVILQMNSLKPEDTAVYYCNA

SEQ ID NO: 1012 - protein, 32 aa, Artificial; identical to SEQ ID NO: 1009
  Framework region 3

SEQ ID NO: 1013 - protein, 32 aa, Artificial; identical to SEQ ID NO: 1009
  Framework region 3

SEQ ID NO: 1014 - protein, 32 aa, Artificial; identical to SEQ ID NO: 1009
  Framework region 3

SEQ ID NO: 1015 - protein, 32 aa, Artificial; identical to SEQ ID NO: 1009
  Framework region 3

SEQ ID NO: 1016 - protein, 32 aa, Artificial; identical to SEQ ID NO: 977
  Framework region 3

SEQ ID NO: 1017 - protein, 32 aa, Artificial
  Framework region 3
RFAISRDNAENTVYLQMNNLKPDDTAVYYCAA

SEQ ID NO: 1018 - protein, 32 aa, Artificial
  Framework region 3
RFTIARDNTKNTAYLQMNSLKPEDTALYFCGA

SEQ ID NO: 1019 - protein, 32 aa, Artificial
  Framework region 3
RFTISRDNAKKMAYLQMLFLKLEDSAVYYCAA

SEQ ID NO: 1020 - protein, 32 aa, Artificial
  Framework region 3
RFTISRDNAKKMAYLQMNSLKLEDTAVYYCAA

SEQ ID NO: 1021 - protein, 32 aa, Artificial; identical to SEQ ID NO: 1019
  Framework region 3

SEQ ID NO: 1022 - protein, 32 aa, Artificial; identical to SEQ ID NO: 1020
  Framework region 3

SEQ ID NO: 1023 - protein, 32 aa, Artificial
  Framework region 3
RFTPSRDNAKKMAYLQMNSLKPEDTAVYYCAA

SEQ ID NO: 1024 - protein, 32 aa, Artificial; identical to SEQ ID NO: 1023
  Framework region 3

SEQ ID NO: 1025 - protein, 32 aa, Artificial
  Framework region 3
RFTISRDNAKKMAYLQMNSLKPEDTAVYYCAV

SEQ ID NO: 1026 - protein, 32 aa, Artificial; identical to SEQ ID NO: 1023
  Framework region 3

SEQ ID NO: 1027 - protein, 32 aa, Artificial
  Framework region 3
RFTISRDNAKKMAYLQMNSLKPEDTASYYCAA

SEQ ID NO: 1028 - protein, 32 aa, Artificial; identical to SEQ ID NO: 982
  Framework region 3

SEQ ID NO: 1029 - protein, 32 aa, Artificial
  Framework region 3
RFTISRDNAKNMAYLQMNSLKPEDTAVYYCAA

SEQ ID NO: 1030 - protein, 32 aa, Artificial; identical to SEQ ID NO: 1029
  Framework region 3

SEQ ID NO: 1031 - protein, 32 aa, Artificial; identical to SEQ ID NO: 982
  Framework region 3

SEQ ID NO: 1032 - protein, 32 aa, Artificial
  Framework region 3
RFTISRDNAKKMAYLQMNSLKPEDAAVYYCAA

SEQ ID NO: 1033 - protein, 32 aa, Artificial; identical to SEQ ID NO: 982
  Framework region 3

SEQ ID NO: 1034 - protein, 32 aa, Artificial; identical to SEQ ID NO: 982
  Framework region 3

SEQ ID NO: 1035 - protein, 32 aa, Artificial
  Framework region 3
RFTISRDNANEMAYLQMNSLNPEDTAVYYCAA

SEQ ID NO: 1036 - protein, 32 aa, Artificial; identical to SEQ ID NO: 1035
  Framework region 3

SEQ ID NO: 1037 - protein, 32 aa, Artificial; identical to SEQ ID NO: 1035
  Framework region 3

SEQ ID NO: 1038 - protein, 32 aa, Artificial
  Framework region 3
RFTISRDNAKKMAYLQMNSLKPEDTSVYYCTA

SEQ ID NO: 1039 - protein, 32 aa, Artificial; identical to SEQ ID NO: 982
  Framework region 3

SEQ ID NO: 1040 - protein, 32 aa, Artificial
  Framework region 3
RFTISRDNAKEMAYLQMNSLKPEDTSVYYCTA

SEQ ID NO: 1041 - protein, 32 aa, Artificial
  Framework region 3
RFTTSRDNAKKMAYLQMNSLKPEDTSVYYCTA

SEQ ID NO: 1042 - protein, 32 aa, Artificial
  Framework region 3
RFTISRDNGKKMAYLQMNSLKPEDTAVYYCAA

SEQ ID NO: 1043 - protein, 32 aa, Artificial; identical to SEQ ID NO: 1038
  Framework region 3

SEQ ID NO: 1044 - protein, 32 aa, Artificial
  Framework region 3
RFTISRDNAKKMAYLQMNSLKPEDTAVYYCAG

SEQ ID NO: 1045 - protein, 32 aa, Artificial; identical to SEQ ID NO: 1044
  Framework region 3

SEQ ID NO: 1046 - protein, 32 aa, Artificial
  Framework region 3
RFTISRDNAEKMVYLQMSSLKPEDTDVYYCAA

SEQ ID NO: 1047 - protein, 32 aa, Artificial
  Framework region 3
RFTISRDNAEKMVYLQMSSLKPEDTDAYYCAA

SEQ ID NO: 1048 - protein, 32 aa, Artificial; identical to SEQ ID NO: 1046
  Framework region 3

SEQ ID NO: 1049 - protein, 32 aa, Artificial
  Framework region 3
RFTISRDNAKKMVYLQMRSLKPEDTDVYYCAA

SEQ ID NO: 1050 - protein, 32 aa, Artificial
  Framework region 3
RFGISRDNAKKMVYLQVSSLKPEDTDVYYCAA

SEQ ID NO: 1051 - protein, 32 aa, Artificial
  Framework region 3
RFTISRDNAKKMVYLQMSSLKPEDTDVYYCAA

SEQ ID NO: 1052 - protein, 32 aa, Artificial
  Framework region 3
RFAISRDNAKKMLYLQMSSLKPEDTDVYYCAA

SEQ ID NO: 1053 - protein, 32 aa, Artificial
  Framework region 3
RFAISRDNAKVMVYLQMSSLKPDDTDVYYCAA

SEQ ID NO: 1054 - protein, 32 aa, Artificial
  Framework region 3
RFTISRDNAKNTVSLQMNNLKPEDTAVYYCAA

SEQ ID NO: 1055 - protein, 32 aa, Artificial
  Framework region 3
RFAISRDNAKNTVYLRMNNLNAEDTAVYYCAA

SEQ ID NO: 1056 - protein, 32 aa, Artificial
  Framework region 3
RFTISRDNAKNTVYLQMNNLKPEDTAVYYCGR

SEQ ID NO: 1057 - protein, 32 aa, Artificial
  Framework region 3
RFTISRDNAKNTVYLQMNNLKPDDTAVYYCGR

SEQ ID NO: 1058 - protein, 32 aa, Artificial
  Framework region 3
RFTISRDNAKNTVYLQMNSLKPEDTAVYYCGR

SEQ ID NO: 1059 - protein, 32 aa, Artificial
  Framework region 3
RFTISRDNAKNTVYLQMNNLKPEDTAVYYCAR

SEQ ID NO: 1060 - protein, 32 aa, Artificial; identical to SEQ ID NO: 1056
  Framework region 3

SEQ ID NO: 1061 - protein, 32 aa, Artificial; identical to SEQ ID NO: 1059
  Framework region 3

SEQ ID NO: 1062 - protein, 32 aa, Artificial
  Framework region 3
RFTISRDNAKNTVCLQMNNLKPEDTAVYYCAQ

SEQ ID NO: 1063 - protein, 32 aa, Artificial; identical to SEQ ID NO: 1059
  Framework region 3

SEQ ID NO: 1064 - protein, 32 aa, Artificial
  Framework region 3
RFTISRDSAKNTVYLQMNNLKPEDTAVYYCAR

SEQ ID NO: 1065 - protein, 32 aa, Artificial
  Framework region 3
RFTISRGNAKNTVYLQMNNLKPEDTAVYYCAR

SEQ ID NO: 1066 - protein, 32 aa, Artificial; identical to SEQ ID NO: 1059
  Framework region 3

SEQ ID NO: 1067 - protein, 32 aa, Artificial
  Framework region 3
RFAISRDNANDTVYLQMNSLKPEDTAIYYCAA

SEQ ID NO: 1068 - protein, 32 aa, Artificial
  Framework region 3
RFAISRBNANDTVYLQMNSLKPEDTAIYYCAA

SEQ ID NO: 1069 - protein, 32 aa, Artificial
  Framework region 3
RFAISRDNAKNTVYLQMNSLKPEDTAIYYCAA

SEQ ID NO: 1070 - protein, 32 aa, Artificial; identical to SEQ ID NO: 1069
  Framework region 3

SEQ ID NO: 1071 - protein, 32 aa, Artificial; identical to SEQ ID NO: 1069
  Framework region 3

SEQ ID NO: 1072 - protein, 32 aa, Artificial
  Framework region 3
RFTISGDNAKNTVDLQMNSLNVEDMAVYYCAA

SEQ ID NO: 1073 - protein, 32 aa, Artificial
  Framework region 3
RFTISRDNAKNTVDLQMNSLNTEDMAVYYCAA

SEQ ID NO: 1074 - protein, 32 aa, Artificial; identical to SEQ ID NO: 983
  Framework region 3

SEQ ID NO: 1075 - protein, 32 aa, Artificial
  Framework region 3
RFTISRDNAKNTVYLQMNSLKPEDTALYYCAR

SEQ ID NO: 1076 - protein, 32 aa, Artificial
  Framework region 3
RFTISRDNAKNTVYLQMNSLKPVDTALYYCAR

SEQ ID NO: 1077 - protein, 32 aa, Artificial; identical to SEQ ID NO: 1075
  Framework region 3

SEQ ID NO: 1078 - protein, 32 aa, Artificial
  Framework region 3
RFTISRDNAKNTVYLQMNSLKPEDAARYYCAA

SEQ ID NO: 1079 - protein, 32 aa, Artificial
  Framework region 3
RFTISRDNAKNTVWLQMNSLKLEDTAVYYCAA

SEQ ID NO: 1080 - protein, 11 aa, Artificial
  Complementary determining region 3
KGSILLNAFDY

SEQ ID NO: 1081 - protein, 20 aa, Artificial
  Complementary determining region 3
DLGGRTLYGGIHYSPEEYAY

SEQ ID NO: 1082 - protein, 18 aa, Artificial
  Complementary determining region 3
GQWTWSPLRVSRLAEYNY

SEQ ID NO: 1083 - protein, 11 aa, Artificial
  Complementary determining region 3
QGSLLLAKYDY

SEQ ID NO: 1084 - protein, 10 aa, Artificial
  Complementary determining region 3
QGGVLSGWDY

SEQ ID NO: 1085 - protein, 26 aa, Artificial
  Complementary determining region 3
VHGLKLPTLRGLGGSYYYLQARSYDY

SEQ ID NO: 1086 - protein, 16 aa, Artificial
  Complementary determining region 3
APVPWGTRPSLLTYDS

SEQ ID NO: 1087 - protein, 15 aa, Artificial
  Complementary determining region 3
KGGRWGPRNDDRYDY

SEQ ID NO: 1088 - protein, 7 aa, Artificial
  Complementary determining region 3
WVLGNDY

SEQ ID NO: 1089 - protein, 7 aa, Artificial
  Complementary determining region 3
WVLGNDY

SEQ ID NO: 1090 - protein, 7 aa, Artificial
  Complementary determining region 3
WVLGNDY

SEQ ID NO: 1091 - protein, 7 aa, Artificial
  Complementary determining region 3
WVLGNDY

SEQ ID NO: 1092 - protein, 26 aa, Artificial
  Complementary determining region 3
VHGLKLPTLRGLGGSYYYLQARSYDY

SEQ ID NO: 1093 - protein, 26 aa, Artificial
  Complementary determining region 3
VHGLKLPTLRGLGGSYYYLQARSYDY

SEQ ID NO: 1094 - protein, 26 aa, Artificial
  Complementary determining region 3
VHGLKLPTLRGLGGSYYYLQARSYDY

SEQ ID NO: 1095 - protein, 26 aa, Artificial
  Complementary determining region 3
VHGLKLPTLRGLGGSYYYLQARSYDY

SEQ ID NO: 1096 - protein, 26 aa, Artificial
  Complementary determining region 3
VHGLKLPSQRGLGGSYYYLLPRSYDY

SEQ ID NO: 1097 - protein, 26 aa, Artificial
  Complementary determining region 3
VHGLKLPSQRGLGGSYYYLLARSYDY

SEQ ID NO: 1098 - protein, 10 aa, Artificial
  Complementary determining region 3
EMSGISGWDY

SEQ ID NO: 1099 - protein, 10 aa, Artificial
  Complementary determining region 3
EMSGISGWDY

SEQ ID NO: 1100 - protein, 10 aa, Artificial
  Complementary determining region 3
EMSGISGWDY

SEQ ID NO: 1101 - protein, 10 aa, Artificial
  Complementary determining region 3
EMTGITGWDY

SEQ ID NO: 1102 - protein, 10 aa, Artificial
  Complementary determining region 3
QGGVLSGWDY

SEQ ID NO: 1103 - protein, 10 aa, Artificial
  Complementary determining region 3
QGGVLSGWDY

SEQ ID NO: 1104 - protein, 10 aa, Artificial
  Complementary determining region 3
QGGVLSGWDY

SEQ ID NO: 1105 - protein, 6 aa, Artificial
  Complementary determining region 3
WSGRDY

SEQ ID NO: 1106 - protein, 17 aa, Artificial
  Complementary determining region 3
DYRDFGLSMERFIDFGS

SEQ ID NO: 1107 - protein, 17 aa, Artificial
  Complementary determining region 3
DYRDFGLSMERFTDFGS

SEQ ID NO: 1108 - protein, 17 aa, Artificial
  Complementary determining region 3
DYRDFGLSMERFVDFGS

SEQ ID NO: 1109 - protein, 11 aa, Artificial
  Complementary determining region 3
RGSDKLLMRTY

SEQ ID NO: 1110 - protein, 11 aa, Artificial
  Complementary determining region 3
RGSDKLLMRTY

SEQ ID NO: 1111 - protein, 11 aa, Artificial
  Complementary determining region 3
LGSDKLLIRTY

SEQ ID NO: 1112 - protein, 11 aa, Artificial
  Complementary determining region 3
RGSSGLSMSTY

SEQ ID NO: 1113 - protein, 11 aa, Artificial
  Complementary determining region 3
RGSILLDPINY

SEQ ID NO: 1114 - protein, 11 aa, Artificial
  Complementary determining region 3
RGSILLDPSNY

SEQ ID NO: 1115 - protein, 11 aa, Artificial
  Complementary determining region 3
RGSILLDRVNY

SEQ ID NO: 1116 - protein, 11 aa, Artificial
  Complementary determining region 3
HGSILLDRSNY

SEQ ID NO: 1117 - protein, 11 aa, Artificial
  Complementary determining region 3
HGSILLNRSNY

SEQ ID NO: 1118 - protein, 11 aa, Artificial
  Complementary determining region 3
HGSILLDRTNY

SEQ ID NO: 1119 - protein, 11 aa, Artificial
  Complementary determining region 3
HGSILLDRIEY

SEQ ID NO: 1120 - protein, 20 aa, Artificial
  Complementary determining region 3
DLGGRTLFGGIHYSPEEYAY

SEQ ID NO: 1121 - protein, 15 aa, Artificial
  Complementary determining region 3
AELKGRNLRVPDYEH

SEQ ID NO: 1122 - protein, 13 aa, Artificial
  Complementary determining region 3
GRQYSTGPYWYDY

SEQ ID NO: 1123 - protein, 16 aa, Artificial
  Complementary determining region 3
APVPWGTRPSTFPYDS

SEQ ID NO: 1124 - protein, 16 aa, Artificial
  Complementary determining region 3
APVPWGTRPSTFPYDS

SEQ ID NO: 1125 - protein, 16 aa, Artificial
  Complementary determining region 3
APVPWGTRPSTFPYDS

SEQ ID NO: 1126 - protein, 16 aa, Artificial
  Complementary determining region 3
APVPWGTRPSTFPYDS

SEQ ID NO: 1127 - protein, 16 aa, Artificial
  Complementary determining region 3
APVPWGTRPSFFPYDS

SEQ ID NO: 1128 - protein, 16 aa, Artificial
  Complementary determining region 3
APVPWGTRPSLFPYDS

SEQ ID NO: 1129 - protein, 16 aa, Artificial
  Complementary determining region 3
APVPWGTRPSLFPYDS

SEQ ID NO: 1130 - protein, 16 aa, Artificial
  Complementary determining region 3
APVPWGTRPSLFPYDS

SEQ ID NO: 1131 - protein, 16 aa, Artificial
  Complementary determining region 3
APVPWGTRPSFLTYDS

SEQ ID NO: 1132 - protein, 16 aa, Artificial
  Complementary determining region 3
APVPWGTRPSFLTYDS

SEQ ID NO: 1133 - protein, 16 aa, Artificial
  Complementary determining region 3
APVPWGTRPSLLTYDS

SEQ ID NO: 1134 - protein, 16 aa, Artificial
  Complementary determining region 3
APVPWGTRPSLLTYDS

SEQ ID NO: 1135 - protein, 16 aa, Artificial
  Complementary determining region 3
APVPWGTRPSFFTYDS

SEQ ID NO: 1136 - protein, 16 aa, Artificial
  Complementary determining region 3
APVPWGTRPSFFTYDS

SEQ ID NO: 1137 - protein, 16 aa, Artificial
  Complementary determining region 3
APVPWGTRPSFFTYDS

SEQ ID NO: 1138 - protein, 16 aa, Artificial
  Complementary determining region 3
APVPWGTRPSFFTYDS

SEQ ID NO: 1139 - protein, 16 aa, Artificial
  Complementary determining region 3
APVPWGTRPSHFTYDS

SEQ ID NO: 1140 - protein, 16 aa, Artificial
  Complementary determining region 3
APVPWGTRPSHFTYDS

SEQ ID NO: 1141 - protein, 16 aa, Artificial
  Complementary determining region 3
APVPWGTRPSHFTYDS

SEQ ID NO: 1142 - protein, 16 aa, Artificial
  Complementary determining region 3
APVPWGTRPSLFTYDS

SEQ ID NO: 1143 - protein, 16 aa, Artificial
  Complementary determining region 3
APVPWGTRPSLFTYDS

SEQ ID NO: 1144 - protein, 16 aa, Artificial
  Complementary determining region 3
APVPWGTRPSLFTYDS

SEQ ID NO: 1145 - protein, 16 aa, Artificial
  Complementary determining region 3
APVPWGTRPSLFTYDS

SEQ ID NO: 1146 - protein, 16 aa, Artificial
  Complementary determining region 3
APVPWGTRPSLFTYDS

SEQ ID NO: 1147 - protein, 16 aa, Artificial
  Complementary determining region 3
APVPWGTRPSLFTYDS

SEQ ID NO: 1148 - protein, 16 aa, Artificial
  Complementary determining region 3
APVPWGARPSLFTYDS

SEQ ID NO: 1149 - protein, 16 aa, Artificial
  Complementary determining region 3
APVPWGARPSLFTYDS

SEQ ID NO: 1150 - protein, 16 aa, Artificial
  Complementary determining region 3
ARVPWSPRPSLSPYDY

SEQ ID NO: 1151 - protein, 16 aa, Artificial
  Complementary determining region 3
ARVPWSPRPSLSPYDY

SEQ ID NO: 1152 - protein, 16 aa, Artificial
  Complementary determining region 3
ARVPWSPRPSLSTYDY

SEQ ID NO: 1153 - protein, 16 aa, Artificial
  Complementary determining region 3
ARVPWSPRPSLSTYDY

SEQ ID NO: 1154 - protein, 16 aa, Artificial
  Complementary determining region 3
ARGPWTPRPSLLTYDY

SEQ ID NO: 1155 - protein, 16 aa, Artificial
  Complementary determining region 3
GRGPWSPRPSLLTYDY

SEQ ID NO: 1156 - protein, 16 aa, Artificial
  Complementary determining region 3
ARGPWSARPSLLTYDY

SEQ ID NO: 1157 - protein, 16 aa, Artificial
  Complementary determining region 3
ARGPWNARPSLLTYDY

SEQ ID NO: 1158 - protein, 17 aa, Artificial
  Complementary determining region 3
DTNGRWRPAIRPSDFEI

SEQ ID NO: 1159 - protein, 15 aa, Artificial
  Complementary determining region 3
RSGWGAAMRSADFRS

SEQ ID NO: 1160 - protein, 17 aa, Artificial
  Complementary determining region 3
HRSVGWRASHHLSDYDN

SEQ ID NO: 1161 - protein, 17 aa, Artificial
  Complementary determining region 3
HRSVGWRASHHLSDYDN

SEQ ID NO: 1162 - protein, 17 aa, Artificial
  Complementary determining region 3
HRSVGWRASHHLSDYDN

SEQ ID NO: 1163 - protein, 17 aa, Artificial
  Complementary determining region 3
HRSVGWRASHHLSDYDN

SEQ ID NO: 1164 - protein, 17 aa, Artificial
  Complementary determining region 3
HRSVGWRASHHLSDYDN

SEQ ID NO: 1165 - protein, 17 aa, Artificial
  Complementary determining region 3
HRSVGWRASHHLSDYDN

SEQ ID NO: 1166 - protein, 17 aa, Artificial
  Complementary determining region 3
HRSVGWRASHHLSDYDN

SEQ ID NO: 1167 - protein, 17 aa, Artificial
  Complementary determining region 3
HHSVGWRASHHLSDYDN

SEQ ID NO: 1168 - protein, 17 aa, Artificial
  Complementary determining region 3
ARSVGWRASHHLSDYDN

SEQ ID NO: 1169 - protein, 17 aa, Artificial
  Complementary determining region 3
DRSVGWRASHHLSDYGN

SEQ ID NO: 1170 - protein, 17 aa, Artificial
  Complementary determining region 3
DRSVGWRASHHLSDFDT

SEQ ID NO: 1171 - protein, 15 aa, Artificial
  Complementary determining region 3
GLTGWAVIPSRTLTT

SEQ ID NO: 1172 - protein, 15 aa, Artificial
  Complementary determining region 3
GLTGWAVIPSRTLTT

SEQ ID NO: 1173 - protein, 15 aa, Artificial
  Complementary determining region 3
GLTSWALIPSRTLTT

SEQ ID NO: 1174 - protein, 15 aa, Artificial
  Complementary determining region 3
GLTSWALIPSRTLTT

SEQ ID NO: 1175 - protein, 15 aa, Artificial
  Complementary determining region 3
GLTSWALIPSRTLTT

SEQ ID NO: 1176 - protein, 19 aa, Artificial
  Complementary determining region 3
DVISGRWYGGAFTPSRFDY

SEQ ID NO: 1177 - protein, 19 aa, Artificial
  Complementary determining region 3
DVISGRWYAGAFTPSRFDY

SEQ ID NO: 1178 - protein, 15 aa, Artificial
  Complementary determining region 3
KGGRWGPRNDDRYDY

SEQ ID NO: 1179 - protein, 17 aa, Artificial
  Complementary determining region 3
NRRAWSLSVHTTREYDD

SEQ ID NO: 1180 - protein, 17 aa, Artificial
  Complementary determining region 3
NRRAWSLSVHTTREYDD

SEQ ID NO: 1181 - protein, 17 aa, Artificial
  Complementary determining region 3
NRRAWSLSVHTTREYDD

SEQ ID NO: 1182 - protein, 15 aa, Artificial
  Complementary determining region 3
DRRAWSARPDMGNYY

SEQ ID NO: 1183 - protein, 17 aa, Artificial
  Complementary determining region 3
DPSGWGLRQHSENEYPY

SEQ ID NO: 1184 - protein, 11 aa, Artificial
  Framework region 4
WGKGTQVTVSS

SEQ ID NO: 1185 - protein, 11 aa, Artificial
  Framework region 4
WGQGTQVTVSS

SEQ ID NO: 1186 - protein, 11 aa, Artificial
  Framework region 4
WGQGTQVTVSS

SEQ ID NO: 1187 - protein, 11 aa, Artificial
  Framework region 4
YGQGTQVTVSS

SEQ ID NO: 1188 - protein, 11 aa, Artificial
  Framework region 4
WGQGTQVTVSS

SEQ ID NO: 1189 - protein, 11 aa, Artificial
  Framework region 4
WGQGTQVTVSS

SEQ ID NO: 1190 - protein, 11 aa, Artificial
  Framework region 4
WGQGTQVTVSS

SEQ ID NO: 1191 - protein, 11 aa, Artificial
  Framework region 4
WGQGTQVTVSS

SEQ ID NO: 1192 - protein, 11 aa, Artificial
  Framework region 4
WGQGTQVTVSS

SEQ ID NO: 1193 - protein, 11 aa, Artificial
  Framework region 4
WGQRTQVTVSS

SEQ ID NO: 1194 - protein, 11 aa, Artificial
  Framework region 4
WGQGTQVTVSS

SEQ ID NO: 1195 - protein, 11 aa, Artificial
  Framework region 4
WGQGTQVTVSS

SEQ ID NO: 1196 - protein, 11 aa, Artificial
  Framework region 4
WGQGTQVTVSS

SEQ ID NO: 1197 - protein, 11 aa, Artificial
  Framework region 4
WGQGTQVTVSS

SEQ ID NO: 1198 - protein, 11 aa, Artificial
  Framework region 4
WGQGTQVTVSS

SEQ ID NO: 1199 - protein, 11 aa, Artificial
  Framework region 4
WGQGTQVTVSS

SEQ ID NO: 1200 - protein, 11 aa, Artificial
  Framework region 4
WGQGTQVTVSS

SEQ ID NO: 1201 - protein, 11 aa, Artificial
  Framework region 4
WGQGTQVTVSS

SEQ ID NO: 1202 - protein, 11 aa, Artificial
  Framework region 4
WGQGTQVTVSS

SEQ ID NO: 1203 - protein, 11 aa, Artificial
  Framework region 4
WGQGTQVTVSS

SEQ ID NO: 1204 - protein, 11 aa, Artificial
  Framework region 4
WGQGTQVTVSS

SEQ ID NO: 1205 - protein, 11 aa, Artificial
  Framework region 4
WGQGTQVTVSS

SEQ ID NO: 1206 - protein, 11 aa, Artificial
  Framework region 4
WGQGTQVTVSS

SEQ ID NO: 1207 - protein, 11 aa, Artificial
  Framework region 4
WGQGTQVTVSS

SEQ ID NO: 1208 - protein, 11 aa, Artificial
  Framework region 4
WGQGTQVTVSS

SEQ ID NO: 1209 - protein, 11 aa, Artificial
  Framework region 4
WGQGTQVTVSS

SEQ ID NO: 1210 - protein, 11 aa, Artificial
  Framework region 4
WGQGTQVTVSS

SEQ ID NO: 1211 - protein, 11 aa, Artificial
  Framework region 4
WGQGTQVTVSS

SEQ ID NO: 1212 - protein, 11 aa, Artificial
  Framework region 4
WGQGTQVTVSS

SEQ ID NO: 1213 - protein, 11 aa, Artificial
  Framework region 4
WGQGTQVTVSS

SEQ ID NO: 1214 - protein, 11 aa, Artificial
  Framework region 4
WGQGTQVTVSS

SEQ ID NO: 1215 - protein, 11 aa, Artificial
  Framework region 4
WGQGTQVTVSS

SEQ ID NO: 1216 - protein, 11 aa, Artificial
  Framework region 4
WGQGTQVTVSS

SEQ ID NO: 1217 - protein, 11 aa, Artificial
  Framework region 4
WGQGTQVTVSS

SEQ ID NO: 1218 - protein, 11 aa, Artificial
  Framework region 4
WGQGTQVTVSS

SEQ ID NO: 1219 - protein, 11 aa, Artificial
  Framework region 4
WGQGTQVTVSS

SEQ ID NO: 1220 - protein, 11 aa, Artificial
  Framework region 4
WGQGTQVTVSS

SEQ ID NO: 1221 - protein, 11 aa, Artificial
  Framework region 4
WGQGTQVTVSS

SEQ ID NO: 1222 - protein, 11 aa, Artificial
  Framework region 4
WGQGTQVTVSS

SEQ ID NO: 1223 - protein, 11 aa, Artificial
  Framework region 4
WGQGTQVTVSS

SEQ ID NO: 1224 - protein, 11 aa, Artificial
  Framework region 4
WGQGTQVTVSS

SEQ ID NO: 1225 - protein, 11 aa, Artificial
  Framework region 4
WGQGTQVTVSS

SEQ ID NO: 1226 - protein, 11 aa, Artificial
  Framework region 4
WGQGTQVTVSS

SEQ ID NO: 1227 - protein, 11 aa, Artificial
  Framework region 4
WGQGTQVTVSS

SEQ ID NO: 1228 - protein, 11 aa, Artificial
  Framework region 4
WGQGTQVTVSS

SEQ ID NO: 1229 - protein, 11 aa, Artificial
  Framework region 4
WGQGTQVTVSS

SEQ ID NO: 1230 - protein, 11 aa, Artificial
  Framework region 4
WGQGTQVTVSS

SEQ ID NO: 1231 - protein, 11 aa, Artificial
  Framework region 4
WGQGTQVTVSS

SEQ ID NO: 1232 - protein, 11 aa, Artificial
  Framework region 4
WGQGTQVTVSS

SEQ ID NO: 1233 - protein, 11 aa, Artificial
  Framework region 4
WGQGTQVTVSS

SEQ ID NO: 1234 - protein, 11 aa, Artificial
  Framework region 4
WGQGTQVTVSS

SEQ ID NO: 1235 - protein, 11 aa, Artificial
  Framework region 4
WGQGTQVTVSS

SEQ ID NO: 1236 - protein, 11 aa, Artificial
  Framework region 4
WGQGTQVTVSS

SEQ ID NO: 1237 - protein, 11 aa, Artificial
  Framework region 4
WGQGTQVTVSS

SEQ ID NO: 1238 - protein, 11 aa, Artificial
  Framework region 4
WGQGTQVTVSS

SEQ ID NO: 1239 - protein, 11 aa, Artificial
  Framework region 4
WGQGTQVTVSS

SEQ ID NO: 1240 - protein, 11 aa, Artificial
  Framework region 4
WGQGTQVTVSS

SEQ ID NO: 1241 - protein, 11 aa, Artificial
  Framework region 4
WGQGTQVTVSS

SEQ ID NO: 1242 - protein, 11 aa, Artificial
  Framework region 4
WGQGTQVTVSS

SEQ ID NO: 1243 - protein, 11 aa, Artificial
  Framework region 4
WGQGTQVTVSS

SEQ ID NO: 1244 - protein, 11 aa, Artificial
  Framework region 4
WGQGTQVTVSS

SEQ ID NO: 1245 - protein, 11 aa, Artificial
  Framework region 4
WGQGTQVTVSS

SEQ ID NO: 1246 - protein, 11 aa, Artificial
  Framework region 4
WGQGTQVTVSS

SEQ ID NO: 1247 - protein, 11 aa, Artificial
  Framework region 4
WGQGTQVTVSS

SEQ ID NO: 1248 - protein, 11 aa, Artificial
  Framework region 4
WGQGTQVTVSS

SEQ ID NO: 1249 - protein, 11 aa, Artificial
  Framework region 4
WGQGTQVTVSS

SEQ ID NO: 1250 - protein, 11 aa, Artificial
  Framework region 4
WGQGTQVTVSS

SEQ ID NO: 1251 - protein, 11 aa, Artificial
  Framework region 4
WGQGTQVTVSS

SEQ ID NO: 1252 - protein, 11 aa, Artificial
  Framework region 4
WGQGTQVTVSS

SEQ ID NO: 1253 - protein, 11 aa, Artificial
  Framework region 4
WGQGTQVTVSS

SEQ ID NO: 1254 - protein, 11 aa, Artificial
  Framework region 4
WGQGTQVTVSS

SEQ ID NO: 1255 - protein, 11 aa, Artificial
  Framework region 4
WGQGTQVTVSS

SEQ ID NO: 1256 - protein, 11 aa, Artificial
  Framework region 4
WGQGTQVTVSS

SEQ ID NO: 1257 - protein, 11 aa, Artificial
  Framework region 4
WGQGTQVTVSS

SEQ ID NO: 1258 - protein, 11 aa, Artificial
  Framework region 4
WGQGTQVTVSS

SEQ ID NO: 1259 - protein, 11 aa, Artificial
  Framework region 4
WGQGTQVTVSS

SEQ ID NO: 1260 - protein, 11 aa, Artificial
  Framework region 4
WGQGTQVTVSS

SEQ ID NO: 1261 - protein, 11 aa, Artificial
  Framework region 4
WGQGTQVTVSS

SEQ ID NO: 1262 - protein, 11 aa, Artificial
  Framework region 4
WGQGTQVTVSS

SEQ ID NO: 1263 - protein, 11 aa, Artificial
  Framework region 4
WGQGTQVTVSS

SEQ ID NO: 1264 - protein, 11 aa, Artificial
  Framework region 4
WGQGTQVTVSS

SEQ ID NO: 1265 - protein, 11 aa, Artificial
  Framework region 4
WGQGTQVTVSS

SEQ ID NO: 1266 - protein, 11 aa, Artificial
  Framework region 4
WGQGTQVTVSS

SEQ ID NO: 1267 - protein, 11 aa, Artificial
  Framework region 4
WGQGTQVTVSS

SEQ ID NO: 1268 - protein, 11 aa, Artificial
  Framework region 4
WGQGTQVTVSS

SEQ ID NO: 1269 - protein, 11 aa, Artificial
  Framework region 4
WGQGTQVTVSS

SEQ ID NO: 1270 - protein, 11 aa, Artificial
  Framework region 4
WGQGTQVTVSS

SEQ ID NO: 1271 - protein, 11 aa, Artificial
  Framework region 4
WGQGTQVTVSS

SEQ ID NO: 1272 - protein, 11 aa, Artificial
  Framework region 4
WGQGTQVTVSS

SEQ ID NO: 1273 - protein, 11 aa, Artificial
  Framework region 4
WGQGTQVTVSS

SEQ ID NO: 1274 - protein, 11 aa, Artificial
  Framework region 4
WGQGTQVTVSS

SEQ ID NO: 1275 - protein, 11 aa, Artificial
  Framework region 4
WGQGTQVTVSS

SEQ ID NO: 1276 - protein, 11 aa, Artificial
  Framework region 4
WGQGTQVTVSS

SEQ ID NO: 1277 - protein, 11 aa, Artificial
  Framework region 4
WGQGTQVTVSS

SEQ ID NO: 1278 - protein, 11 aa, Artificial
  Framework region 4
WGQGTQVTVSS

SEQ ID NO: 1279 - protein, 11 aa, Artificial
  Framework region 4
WGQGTQVTVSS

SEQ ID NO: 1280 - protein, 11 aa, Artificial
  Framework region 4
WGQGTQVTVSS

SEQ ID NO: 1281 - protein, 11 aa, Artificial
  Framework region 4
WGQGTQVTVSS

SEQ ID NO: 1282 - protein, 11 aa, Artificial
  Framework region 4
WGQGTQVTVSS

SEQ ID NO: 1283 - protein, 11 aa, Artificial
  Framework region 4
WGQGTQVTVSS

SEQ ID NO: 1284 - protein, 11 aa, Artificial
  Framework region 4
WGQGTQVTVSS

SEQ ID NO: 1285 - protein, 11 aa, Artificial
  Framework region 4
WGQGTQVTVSS

SEQ ID NO: 1286 - protein, 11 aa, Artificial
  Framework region 4
WGQGTQVTVSS

SEQ ID NO: 1287 - protein, 11 aa, Artificial
  Framework region 4
WGLGTQVTVSS

SEQ ID NO: 1288 - protein, 119 aa, Artificial
  Nanobody against CTLA4
EVQLVESGGGLVQPGGSLRLSCAASGSILSIAVAGWYRRQPGKERELVATISPGNNTHYVDSVKGRFTISRDNAKNTVYLQMTTLKPDDTAAYYCNAKGSILLNAFDYWGKGTQVTVSS

SEQ ID NO: 1289 - protein, 129 aa, Artificial
  Nanobody against CTLA4
EVQLVESGGGLVQAGGSLRLSCAASGRTSSTATVGWFRQAPGKEREFVAVINWRSGFTYYADSVKGRFTISREYAKNTVYLQMDSLKPEDTAVYSCAADLGGRTLYGGIHYSPEEYAYWGQGTQVTVSS

SEQ ID NO: 1290 - protein, 126 aa, Artificial
  Nanobody against CTLA4
EVQLVESGGGLVQAGGSLRLSCAASGGTFSSYAMGWFRQAPGKEREFVAAISPSGLTSYKDSVVGRFTISRDNAKNTVYLQMNSLKPEDTAVHYCAAGQWTWSPLRVSRLAEYNYWGQGTQVTVSS

SEQ ID NO: 1291 - protein, 119 aa, Artificial
  Nanobody against CTLA4
EVQLVESGGGLVQPGESLRLSCAASKSIFSISVMAWYRQAPGKQRELVARITPGGNTNYVDSVQGRFTISRDNAKNTVYLQMNSLKPEDTAVYYCNAQGSLLLAKYDYYGQGTQVTVSS

SEQ ID NO: 1292 - protein, 119 aa, Artificial
  Nanobody against CTLA4
EVQLVESGGGLVQAGGSLRLSCAAPGRTFSNYAMGWFRQAPGKGREFVADIRWSDGRTYYADSVKGRFTVSRDNAKNTVYLQMNSLKPEDTAVYYCAAQGGVLSGWDYWGQGTQVTVSS

SEQ ID NO: 1293 - protein, 135 aa, Artificial
  Nanobody against CTLA4
EVQLVESGGGLVQPGGSLRLSCAASGFTLDYYAIGWFRQAPGKEREGVSCIDSSDGSTYYADSVKGRFTISRDNAKNTVYLQMNSLKPEDTAVYYCAAVHGLKLPTLRGLGGSYYYLQARSYDYWGQGTQVTVSS

SEQ ID NO: 1294 - protein, 125 aa, Artificial
  Nanobody against CTLA4
EVQLVESGGGLVQTGGSLRLSCAASGRTFSSYTMGWFRQAPGKDREFVAAISRSGSLTSYADSVKGRFTISRDNAKKMAYLQMNSLKPEDTAVYYCAAAPVPWGTRPSLLTYDSWGQGTQVTVSS

SEQ ID NO: 1295 - protein, 124 aa, Artificial
  Nanobody against CTLA4
EVQLVESGGGLVQAGGSLRLSCAASGRTLTTYIMGWFRQAPGKEREFVAATSPSGTLTSYADSVKGRFSMSRDNAKKMVDLQMNSLKPEDTAVYYCAAKGGRWGPRNDDRYDYWGQGTQVTVSS

SEQ ID NO: 1296 - protein, 115 aa, Artificial
  Nanobody against CTLA4
EVQLVESGGGLVEPGGSLRLSCAASGSISSYNVMGWYRQAPGQQRDLVAHIASNGEIMYADSAKGRFTISRDNAKKTVYLQMNSLKPEDTAVYYCKLWVLGNDYWGQGTQVTVSS

SEQ ID NO: 1297 - protein, 115 aa, Artificial
  Nanobody against CTLA4
EVQLVESGGGLVEPGGSLRLSCAASGSISSYNVMGWYRQAPGQQRDLVAHIASNGEIMYADSAKGRFTISRDNAKKTVYLQMNSLKPEDTAVYYCKLWVLGNDYWGQRTQVTVSS

SEQ ID NO: 1298 - protein, 115 aa, Artificial
  Nanobody against CTLA4
EVQLVESGGGLVEPGGSLRLSCAASGSISSFNVMGWYRQAPGQQRDLVAHIASNGEIMYADSVKGRFTISRDNAKKTVYLQMNSLKPEDTAVYYCKLWVLGNDYWGQGTQVTVSS

SEQ ID NO: 1299 - protein, 115 aa, Artificial
  Nanobody against CTLA4
EVQLVESGGGLVQTGGSLRLSCAASGSISSFNVMGWYRQAPGKQRDLVAHIASGGEIMYTDSVKGRFTISRDNAKKTVYLQMNSLKPEDTAVYYCKLWVLGNDYWGQGTQVTVSS

SEQ ID NO: 1300 - protein, 135 aa, Artificial
  Nanobody against CTLA4
EVQLVESGGGLVQPGGSLRLSCAASGFTLDYYAIGWFRQAPGKEREGVSCIVGSDGSTYYADSVKGRFTISRDNAKNTVYLQMNSLKPEDTAVYYCAAVHGLKLPTLRGLGGSYYYLQARSYDYWGQGTQVTVSS

SEQ ID NO: 1301 - protein, 135 aa, Artificial; identical to SEQ ID NO: 1293
  Nanobody against CTLA4

SEQ ID NO: 1302 - protein, 135 aa, Artificial
  Nanobody against CTLA4
EVQLVESGGGLVQPGGSLRLSCAASGFTLDYYAIGWFRQAPGKEREGVSCISLSDGSTYYADSVKGRFTISRDNAKNTVYLQMNSLKPEDTAVYYCAAVHGLKLPTLRGLGGSYYYLQARSYDYWGQGTQVTVSS

SEQ ID NO: 1303 - protein, 135 aa, Artificial
  Nanobody against CTLA4
EVQLVESGGGLVQPGGSLRLSCAASGFTLDYYAIGWFRQAPGKEREGVSCIVSSDGSTYYADSVKSRFTISRDNAKNTVYLHMNSLKPEDTAVYYCAAVHGLKLPTLRGLGGSYYYLQARSYDYWGQGTQVTVSS

SEQ ID NO: 1304 - protein, 135 aa, Artificial
  Nanobody against CTLA4
EVQLVESGGGLVQPGGSLRLSCAASGFTLDYYAIGWFRQAPGKEREGVSCITISDGDTYYADSVKGRFTISRDNANNTVNLQMNSLKPEDTAVYYCAAVHGLKLPSQRGLGGSYYYLLPRSYDYWGQGTQVTVSS

SEQ ID NO: 1305 - protein, 135 aa, Artificial
  Nanobody against CTLA4
EVQLVESGGGLVQPGGSLRLSCAASGFTLDYYAIGWFRQAPGKEREGVSCITISDGDTYYADSVKGRFTIARDYAKNTVYLQMNSLKPEDTAVYYCAAVHGLKLPSQRGLGGSYYYLLARSYDYWGQGTQVTVSS

SEQ ID NO: 1306 - protein, 119 aa, Artificial
  Nanobody against CTLA4
EVQLVESGGGLVQAGGSLRLSCAASGGTFSFYGMGWFRQAPGKEQEFVADIRTSAGRTYYADSVKGRFTISRDNAKNTVYLQMNSLKPEDTAVYYCAAEMSGISGWDYWGQGTQVTVSS

SEQ ID NO: 1307 - protein, 119 aa, Artificial
  Nanobody against CTLA4
EMQLVESGGGLVQAGGSLRLSCAASGGTFSFYGMGWFRQAPGKEQEFVADIRTSAGRTYYADSVKGRFTISRDNAKNTVYLQMNSLKPEDTAVYYCAAEMSGISGWDYWGQGTQVTVSS

SEQ ID NO: 1308 - protein, 119 aa, Artificial
  Nanobody against CTLA4
EVQLVESGGGLVQAGGSLRLSCAASGGTFSFYGMGWFRQAPGKEREFVADIRTSAGRTYYADSVKGRFTISRDNAKNTVYLQMNSLKPEDTAVYYCAAEMSGISGWDYWGQGTQVTVSS

SEQ ID NO: 1309 - protein, 119 aa, Artificial
  Nanobody against CTLA4
EVQLVESGGGLVQAGGSLRLSCAASGGTFSSYGMGWFRQAPGKEREFVADIRSSAGRTYYAGSVKGRFTISRDNAKNTVYLQMNSLKPEDTAVYYCAAEMTGITGWDYWGQGTQVTVSS

SEQ ID NO: 1310 - protein, 119 aa, Artificial
  Nanobody against CTLA4
KVQLVESGGGLVQAGGSLRLSCAAPGRTFSNYAMGWFRQAPGKGREFVADIRWSDGRTYYADSVKGRFTVSRDNAKNTVYLQMNSLKPEDTAVYYCAAQGGVLSGWDYWGQGTQVTVSS

SEQ ID NO: 1311 - protein, 119 aa, Artificial; identical to SEQ ID NO: 1292
  Nanobody against CTLA4

SEQ ID NO: 1312 - protein, 119 aa, Artificial
  Nanobody against CTLA4
EVQLVESGGGLVQPGGSLRLSCAAPGRTFSNYAMGWFRQAPGKGREFVADIRWSDGRTYYADSVKGRFTVSRDNAKNTVYLQMNSLKPEDTAVYYCAAQGGVLSGWDYWGQGTQVTVSS

SEQ ID NO: 1313 - protein, 114 aa, Artificial
  Nanobody against CTLA4
EVQLVESGGGLVQPGGSLRLSCVASGIHFAISTINWYRQAPGKQRESVAAITGTSVTGYADSVKGRFTLSRDNAKNTVYLQMDNLKPEDTAVYYCNVWSGRDYWGQGTQVTVSS

SEQ ID NO: 1314 - protein, 125 aa, Artificial
  Nanobody against CTLA4
EVQLVESGGGLVQPAGSLRLSCADSGSIFSINTMGWYRQAPGKQRELVATITSSGSTNYADSVKGRFTISRDNAKNTVYLQMNSLKPEDTAVYYCNADYRDFGLSMERFIDFGSWGQGTQVTVSS

SEQ ID NO: 1315 - protein, 125 aa, Artificial
  Nanobody against CTLA4
EVQLVESGGGLVQPGGSLRLSCADAGSIFSINTMGWYRQAPGKQRELVAAITSGGSTNYADSVKGRFTISRDNAKNTVYLQMNSLKPEDTAVYYCNADYRDFGLSMERFTDFGSWGQGTQVTVSS

SEQ ID NO: 1316 - protein, 125 aa, Artificial
  Nanobody against CTLA4
KVQLVESGGGLVQPGGSLRLSCAASGSDFSLNAMGWYRQAPGKQRELVAAITSGGSTNYADSVKGRFTISRDNAKNTVYLQMNSLKPEDTAVYYCNADYRDFGLSMERFVDFGSWGQGTQVTVSS

SEQ ID NO: 1317 - protein, 119 aa, Artificial
  Nanobody against CTLA4
EMQLVESGGGLVQPGGSLRLSCAASGNIFSRYIMGWYRQAPGKQRELVADITPGGNTNYADSVKGRFTISRDGAKNTVGLQMNSLRPEDTAVYSCYARGSDKLLMRTYWGQGTQVTVSS

SEQ ID NO: 1318 - protein, 119 aa, Artificial
  Nanobody against CTLA4
EVQLVESGGGLVQPGGSLRLSCAASGNIFSRYIMGWYRQAPGKERELVADITPGGNTNYANSVKGRFTISRDGAKNTVGLQMNSLRPDDTAVYSCYARGSDKLLMRTYWGQGTQVTVSS

SEQ ID NO: 1319 - protein, 119 aa, Artificial
  Nanobody against CTLA4
EVQLVESGGGLVQPGGSLRLSCTASGNIFSRYIMGWYRQAPGKQRELVADITPGGNTNYADSVKGRFSISRDGAKNTVDLQMNSLRPEDTAVYYCNALGSDKLLIRTYWGQGTQVTVSS

SEQ ID NO: 1320 - protein, 119 aa, Artificial
  Nanobody against CTLA4
EVQLVESGGGLVQPGGSLRLSCAASGNIFSRYIMGWYRQAPGKQRESVATITPGGNTDYADSVKGRFTISRDGAKNTVDLQMNSLKPEDTAVYYCNARGSSGLSMSTYWGQGTQVTVSS

SEQ ID NO: 1321 - protein, 119 aa, Artificial
  Nanobody against CTLA4
EVQLVESGGGLVQPGGSLRLSCAASGNIFTRNVMGWYRQAPGKQRDLVASITPGGNIYYADSVKGRFTISRDGAKNTVYLQMNSLKPEDTAVYYCNARGSILLDPINYWGQGTQVTVSS

SEQ ID NO: 1322 - protein, 119 aa, Artificial
  Nanobody against CTLA4
EVQLVESGGGLVQPGGSLRLSCAASGNIFTRNIMGWYRQAPGNQRDLVASITPGGNMYYADSVKGRFTISRDGAKNTVYLQMNSLKPEDTAVYYCNARGSILLDPSNYWGQGTQVTVSS

SEQ ID NO: 1323 - protein, 119 aa, Artificial
  Nanobody against CTLA4
EVQLVESGGGLVQPGGSLRLSCAASGNIFTRNVMGWYRQAPGNQRDLVASITPGGNIYYADSVKGRFTISRDGAKSTVILQMNSLKPEDTAVYYCNARGSILLDRVNYWGQGTQVTVSS

SEQ ID NO: 1324 - protein, 119 aa, Artificial
  Nanobody against CTLA4
EVQLVESGGGLVQPGGSLRLSCAASRDIFTRNIMGWYRQAPGKQRDLVASITPGGNMYYADSVKGRFTISRDGAKNTVYLQMNSLKPEDTAVYYCNAHGSILLDRSNYWGQGTQVTVSS

SEQ ID NO: 1325 - protein, 119 aa, Artificial
  Nanobody against CTLA4
EVQLVESGGGLVQPGGSLRLSCAASGNIFTRNIMGWYRQAPGKQRDLVASITPGGNINYADSVKGRFTISRDGAKNTVYLQMNSLKPEDTAVYYCNAHGSILLNRSNYWGQGTQVTVSS

SEQ ID NO: 1326 - protein, 119 aa, Artificial
  Nanobody against CTLA4
EVQLVESGGGLVQPGGSLRLSCAASGNIFTRHIMGWYRQAPGKQRELVASITPGDNINYADSVKGRFTISRDGAKNTVYLQMNSLKPEDTAVYYCNAHGSILLDRTNYWGQGTQVTVSS

SEQ ID NO: 1327 - protein, 119 aa, Artificial
  Nanobody against CTLA4
EVQLVESGGGLVQPGGSLRLSCAASGNIFTRNVMGWYRQAPGKQRDLVASITPGGNINYADSVKGRFTISRDGAKNTVYLQMNSLKPEDTAVYYCNAHGSILLDRIEYWGQGTQVTVSS

SEQ ID NO: 1328 - protein, 129 aa, Artificial
  Nanobody against CTLA4
EVQLVESGGGLVQPGGSLRLSCAASGRTSSTATVGWFRQAPGKEREFVAVINWRSGFTYYADSVKGRFTISREYAKNTVYLQMDSLKPEDTAVYSCAADLGGRTLFGGIHYSPEEYAYWGQGTQVTVSS

SEQ ID NO: 1329 - protein, 123 aa, Artificial
  Nanobody against CTLA4
EVQLMESGGGLVTAGGSLRLSCAASGGTFGHYAMAWFRRPPGNEREFVAGIGWTYTTFYADSVKGRFAISRDNAENTVYLQMNNLKPDDTAVYYCAAAELKGRNLRVPDYEHWGQGTQVTVSS

SEQ ID NO: 1330 - protein, 122 aa, Artificial
  Nanobody against CTLA4
EVQLVESGGGLVQAGGSLRLSCAASGGTFSRYIMAWFRQAPGKEREFVAVIDGSGYSTDYAGSVKGRFTIARDNTKNTAYLQMNSLKPEDTALYFCGAGRQYSTGPYWYDYWGQGTQVTVSS

SEQ ID NO: 1331 - protein, 125 aa, Artificial
  Nanobody against CTLA4
EVQLVESGGGLVQTGGSLRLSCAASGRTFSNYTMGWFRQAPGKDREFVAAISRSGSLKSYADSVKGRFTISRDNAKKMAYLQMLFLKLEDSAVYYCAAAPVPWGTRPSTFPYDSWGQGTQVTVSS

SEQ ID NO: 1332 - protein, 125 aa, Artificial
  Nanobody against CTLA4
EVQLVESGGGLVQTGGSLRLSCAASGRTFSNYTMGWFRQAPGKDREFVAAISRSGNLKSYADSVKGRFTISRDNAKKMAYLQMNSLKLEDTAVYYCAAAPVPWGTRPSTFPYDSWGQGTQVTVSS

SEQ ID NO: 1333 - protein, 125 aa, Artificial
  Nanobody against CTLA4
EVQLMESGGGLVQTGGSLRLSCVASGRTFSNYTMGWFRQAPGKDREFVAAISRSGSLKSYADSVKGRFTISRDNAKKMAYLQMLFLKLEDSAVYYCAAAPVPWGTRPSTFPYDSWGQGTQVTVSS

SEQ ID NO: 1334 - protein, 125 aa, Artificial
  Nanobody against CTLA4
EVQLVESGGGLVQTGGSLRLSCAASGRTFSNYTMGWFRQAPGKDREFVAAISRSGGLKSYADSVKGRFTISRDNAKKMAYLQMNSLKLEDTAVYYCAAAPVPWGTRPSTFPYDSWGQGTQVTVSS

SEQ ID NO: 1335 - protein, 125 aa, Artificial
  Nanobody against CTLA4
EVQLVESGGGLVQTGGSLRLSCAASGRTFSNYTMGWFRQAPGKDREFVAAISRSGALKAYADSVKGRFTPSRDNAKKMAYLQMNSLKPEDTAVYYCAAAPVPWGTRPSFFPYDSWGQGTQVTVSS

SEQ ID NO: 1336 - protein, 125 aa, Artificial
  Nanobody against CTLA4
EVQLVESGGGLVQTGGSLRLSCAASGRTFSNYTMGWFRQAPGKDREFVAAISRSGSLKAYADSVKGRFTPSRDNAKKMAYLQMNSLKPEDTAVYYCAAAPVPWGTRPSLFPYDSWGQGTQVTVSS

SEQ ID NO: 1337 - protein, 125 aa, Artificial
  Nanobody against CTLA4
EVQLVESGGGLVQTGGSLRLSCAASGRTFSSYTMGWFRQAPGKDREFVTAISRSGTLTSYADSVKGRFTISRDNAKKMAYLQMNSLKPEDTAVYYCAVAPVPWGTRPSLFPYDSWGQGTQVTVSS

SEQ ID NO: 1338 - protein, 125 aa, Artificial
  Nanobody against CTLA4
EVQLMESGGGLVQTGGSLRLSCAASGRTFSNYTMGWFRQAPGKDREFVAAISRSGSLKAYADSVKGRFTPSRDNAKKMAYLQMNSLKPEDTAVYYCAAAPVPWGTRPSLFPYDSWGQGTQVTVSS

SEQ ID NO: 1339 - protein, 125 aa, Artificial
  Nanobody against CTLA4
EVQLVESGGGLVQTGGSLRLSCAASGRTFSNYTMGWFRQAPGKDREFVAAISRSGSLKSYADSVNGRFTISRDNAKKMAYLQMNSLKPEDTASYYCAAAPVPWGTRPSFLTYDSWGQGTQVTVSS

SEQ ID NO: 1340 - protein, 125 aa, Artificial
  Nanobody against CTLA4
EVQLVESGGGLVQTGGSLRLSCAASGRTFSNYTMGWFRQAPGKDREFVAAISRSGNLKSYADSVNGRFTISRDNAKKMAYLQMNSLKPEDTAVYYCAAAPVPWGTRPSFLTYDSWGQGTQVTVSS

SEQ ID NO: 1341 - protein, 125 aa, Artificial
  Nanobody against CTLA4
AVQLVESGGGLVQTGGSLRLSCAASGRTFSSYTMGWFRQAPGKDREYVAAISRSGSLKGYADSVKGRFTISRDNAKNMAYLQMNSLKPEDTAVYYCAAAPVPWGTRPSLLTYDSWGQGTQVTVSS

SEQ ID NO: 1342 - protein, 125 aa, Artificial
  Nanobody against CTLA4
EVQLVESGGGLVQTGGSLRLSCAASGRTFSSYTMGWFRQAPGKDREYVAAISRSGSLKGYADSVKGRFTISRDNAKNMAYLQMNSLKPEDTAVYYCAAAPVPWGTRPSLLTYDSWGQGTQVTVSS

SEQ ID NO: 1343 - protein, 125 aa, Artificial
  Nanobody against CTLA4
EVQLVESGGGLVQTGGSLRLSCAASGRTFSNYTMGWFRQAPGKDREFVAAISRSGTLKAYADSVKGRFTISRDNAKKMAYLQMNSLKPEDTAVYYCAAAPVPWGTRPSFFTYDSWGQGTQVTVSS

SEQ ID NO: 1344 - protein, 125 aa, Artificial
  Nanobody against CTLA4
EVQLVESGGGLVQTGGSLRLSCAASGRTFSSYTTGWFRQAPGKDREFVAAISRSGSLTSYADSVKGRFTISRDNAKKMAYLQMNSLKPEDAAVYYCAAAPVPWGTRPSFFTYDSWGQGTQVTVSS

SEQ ID NO: 1345 - protein, 125 aa, Artificial
  Nanobody against CTLA4
EVQLVESGGGLVQTGGSLRLSCAASGRTFSNYTMGWFRQAPGKDREFVAAISRSGSLKAYADSVKGRFTISRDNAKKMAYLQMNSLKPEDTAVYYCAAAPVPWGTRPSFFTYDSWGQGTQVTVSS

SEQ ID NO: 1346 - protein, 125 aa, Artificial
  Nanobody against CTLA4
EVQLVESRGGLVQTGGSLRLSCAASGRTFSNYTMGWFRQAPGKDREFVAAISRSGSLKSYADSVKGRFTISRDNAKKMAYLQMNSLKPEDTAVYYCAAAPVPWGTRPSFFTYDSWGQGTQVTVSS

SEQ ID NO: 1347 - protein, 125 aa, Artificial
  Nanobody against CTLA4
EVQLVESGGGVVQTGGSLRLSCAASGRTFSMYTMGWFRRAPGKDREFVAAISRSGGLKAYADSVLGRFTISRDNANEMAYLQMNSLNPEDTAVYYCAAAPVPWGTRPSHFTYDSWGQGTQVTVSS

SEQ ID NO: 1348 - protein, 125 aa, Artificial
  Nanobody against CTLA4
EVQLVESGGGVVQTGGSLRLSCAASGRTFSMYTMGWFRQAPGEDREFVAAISRSGGLKAYADSVLGRFTISRDNANEMAYLQMNSLNPEDTAVYYCAAAPVPWGTRPSHFTYDSWGQGTQVTVSS

SEQ ID NO: 1349 - protein, 125 aa, Artificial
  Nanobody against CTLA4
EVQLVESGGGVVQTGGSLRLSCAASGRTFSMYTMGWFRQAPGKDREFVAAISRSGGLKAYADSVLGRFTISRDNANEMAYLQMNSLNPEDTAVYYCAAAPVPWGTRPSHFTYDSWGQGTQVTVSS

SEQ ID NO: 1350 - protein, 125 aa, Artificial
  Nanobody against CTLA4
EVQLVESRGGLVQPGGSLRLSCAASGRAFNNYTMGWFRQAPGKDREFVAAISRSGNLKAYADSVNGRFTISRDNAKKMAYLQMNSLKPEDTSVYYCTAAPVPWGTRPSLFTYDSWGQGTQVTVSS

SEQ ID NO: 1351 - protein, 125 aa, Artificial
  Nanobody against CTLA4
EVQPVESGGGLVQTGGSLRLSCAASGRTFSNYTMGWFRQAPGKDREFVAAISRSGNLKAYADSVKGRFTISRDNAKKMAYLQMNSLKPEDTAVYYCAAAPVPWGTRPSLFTYDSWGQGTQVTVSS

SEQ ID NO: 1352 - protein, 125 aa, Artificial
  Nanobody against CTLA4
EVQLVESGGGLVQTGGSLRLSCAASGRAFNNYTMGWFRQAPGKDREFVAAISRSGNLKAYADSVNGRFTISRDNAKEMAYLQMNSLKPEDTSVYYCTAAPVPWGTRPSLFTYDSWGQGTQVTVSS

SEQ ID NO: 1353 - protein, 125 aa, Artificial
  Nanobody against CTLA4
EVQLVESGGGLVQTGGSLRLSCAASGRAFNNYTMGWFRQAPGKDREFVAAISRSGNLKAYADSVNGRFTTSRDNAKKMAYLQMNSLKPEDTSVYYCTAAPVPWGTRPSLFTYDSWGQGTQVTVSS

SEQ ID NO: 1354 - protein, 125 aa, Artificial
  Nanobody against CTLA4
EVQLVESGGGLVQTGGSLRLSCAASGRTFSSYTMGWFRQAPGKDREFVAAISRSGGLTSYADSVKGRFTISRDNGKKMAYLQMNSLKPEDTAVYYCAAAPVPWGTRPSLFTYDSWGQGTQVTVSS

SEQ ID NO: 1355 - protein, 125 aa, Artificial
  Nanobody against CTLA4
EVQLVESGGGLVQTGGSLRLSCAASGRAFNNYTMGWFRQAPGKDREFVAAISRSGNLKAYADSVNGRFTISRDNAKKMAYLQMNSLKPEDTSVYYCTAAPVPWGTRPSLFTYDSWGQGTQVTVSS

SEQ ID NO: 1356 - protein, 125 aa, Artificial
  Nanobody against CTLA4
EVQLVESGGDLVQPGGSLRLSCAASGRTFSNYTVGWFRQAPGKDREFVTAISRSGSLKAYADSVKDRFTISRDNAKKMAYLQMNSLKPEDTAVYYCAGAPVPWGARPSLFTYDSWGQGTQVTVSS

SEQ ID NO: 1357 - protein, 125 aa, Artificial
  Nanobody against CTLA4
EVQLVESGGGLVQTGGSLRLSCAASGRTFSNYTVGWFRQAPGKDREFVTAISRSGSLKAYADSVKDRFTISRDNAKKMAYLQMNSLKPEDTAVYYCAGAPVPWGARPSLFTYDSWGQGTQVTVSS

SEQ ID NO: 1358 - protein, 125 aa, Artificial
  Nanobody against CTLA4
EVQLVESGGELVQAGDSLRLSCAASGRTFSSYIMGWFRQAPGKEREFVAAISPSGALTSYADSVKGRFTISRDNAEKMVYLQMSSLKPEDTDVYYCAAARVPWSPRPSLSPYDYWGQGTQVTVSS

SEQ ID NO: 1359 - protein, 125 aa, Artificial
  Nanobody against CTLA4
EVQLVESGGELVQAGDSLRLSCAASGRTFSSYIMGWFRQAPGKEREFVAAISPSGALTSYADSVKGRFTISRDNAEKMVYLQMSSLKPEDTDAYYCAAARVPWSPRPSLSPYDYWGQGTQVTVSS

SEQ ID NO: 1360 - protein, 125 aa, Artificial
  Nanobody against CTLA4
EVQLVESGGGLVQAGDSLRLSCAASGRTFSSYIMGWFRQAPGKEREFVAAISSSGALTSYADSVKGRFTISRDNAEKMVYLQMSSLKPEDTDVYYCAAARVPWSPRPSLSTYDYWGQGTQVTVSS

SEQ ID NO: 1361 - protein, 125 aa, Artificial
  Nanobody against CTLA4
EVQLVESGGGLVQAGDSLRLSCAASGRTFSSYIMGWFRRAPGKEREFVAAISSSGALTSYADSVVGRFTISRDNAKKMVYLQMRSLKPEDTDVYYCAAARVPWSPRPSLSTYDYWGQGTQVTVSS

SEQ ID NO: 1362 - protein, 125 aa, Artificial
  Nanobody against CTLA4
EVQLVESGGGLVQAGDSLTLSCAASGGTFSTYVMGWFRQASGKEREFVAAISPSGTLTSYADSVKGRFGISRDNAKKMVYLQVSSLKPEDTDVYYCAAARGPWTPRPSLLTYDYWGQGTQVTVSS

SEQ ID NO: 1363 - protein, 125 aa, Artificial
  Nanobody against CTLA4
EVQLVESGGGLVQAGDSLRLSCAASGRTFSSYVMGWFRQAPGKEREFVAAISSSGALTSYADSVYGRFTISRDNAKKMVYLQMSSLKPEDTDVYYCAAGRGPWSPRPSLLTYDYWGQGTQVTVSS

SEQ ID NO: 1364 - protein, 125 aa, Artificial
  Nanobody against CTLA4
EVQLVESGGGLVQAGDSLRLSCAASGRTFSNYVMGWFRQAPGKEREFVSAISPSGTLTSYTDSVKGRFAISRDNAKKMLYLQMSSLKPEDTDVYYCAAARGPWSARPSLLTYDYWGQGTQVTVSS

SEQ ID NO: 1365 - protein, 125 aa, Artificial
  Nanobody against CTLA4
EVQLVESGGGLVQAGDSLRLSCAASGRTFSSYVMGWFRQAPGKEREFVAAISPSGSLTSYADSVKGRFAISRDNAKVMVYLQMSSLKPDDTDVYYCAAARGPWNARPSLLTYDYWGQGTQVTVSS

SEQ ID NO: 1366 - protein, 126 aa, Artificial
  Nanobody against CTLA4
EVQLVESGGGLVQAGGSLSLSCAASGRTFSSITMAWFRQTPGKEREFVAAISRSGSLTSYADSLKGRFTISRDNAKNTVSLQMNNLKPEDTAVYYCAADTNGRWRPAIRPSDFEIWGQGTQVTVSS

SEQ ID NO: 1367 - protein, 124 aa, Artificial
  Nanobody against CTLA4
EVQLVESGGGLVQAGGSLGLSCAASGRSFSMYAMGWFRTAPGKEREFVAAISGSGTLTSYADSVKGRFAISRDNAKNTVYLRMNNLNAEDTAVYYCAARSGWGAAMRSADFRSWGQGTQVTVSS

SEQ ID NO: 1368 - protein, 126 aa, Artificial
  Nanobody against CTLA4
EVQLVESGGQLVQAGGSLRLSCAATGRTYNSYSLGWSRQAPGKEREFVAAISASGTLRAYADSVKGRFTISRDNAKNTVYLQMNNLKPEDTAVYYCGRHRSVGWRASHHLSDYDNWGQGTQVTVSS

SEQ ID NO: 1369 - protein, 126 aa, Artificial
  Nanobody against CTLA4
EVQLVESGGQLVQAGDSLRLSCVATGRTYNSYSLGWSRQAPGKEREFVAAISASGTLRAYADSVKGRFTISRDNAKNTVYLQMNNLKPDDTAVYYCGRHRSVGWRASHHLSDYDNWGQGTQVTVSS

SEQ ID NO: 1370 - protein, 126 aa, Artificial
  Nanobody against CTLA4
EVQLVESGGQLVQAGGSLRLSCAATGRTYNSYSLGWSRQAPGKEREFVAAISASGTLRAYADSVKGRFTISRDNAKNTVYLQMNSLKPEDTAVYYCGRHRSVGWRASHHLSDYDNWGQGTQVTVSS

SEQ ID NO: 1371 - protein, 126 aa, Artificial
  Nanobody against CTLA4
EVQLVESGGQLVQAGGSLRLSCTATGHTYNTYPLGWFRQAPGKEREFVAAISPSGTLRAYADSVKGRFTISRDNAKNTVYLQMNNLKPEDTAVYYCARHRSVGWRASHHLSDYDNWGQGTQVTVSS

SEQ ID NO: 1372 - protein, 126 aa, Artificial
  Nanobody against CTLA4
EVQLVESGGQLVQAGGSLRLSCAATGRMYNSYSLGWSRQAPGKEREFVAAISASGTLRAYADSVKGRFTISRDNAKNTVYLQMNNLKPEDTAVYYCGRHRSVGWRASHHLSDYDNWGQGTQVTVSS

SEQ ID NO: 1373 - protein, 126 aa, Artificial
  Nanobody against CTLA4
EVQLVESGGQLVQAGGSLRLSCAATGHTYNTYPLGWFRQAPGKEREFVAAISPSGTLRAYADSVKGRFTISRDNAKNTVYLQMNNLKPEDTAVYYCARHRSVGWRASHHLSDYDNWGQGTQVTVSS

SEQ ID NO: 1374 - protein, 126 aa, Artificial
  Nanobody against CTLA4
EVQLVESGGQLVQAGGSLRLSCAATGRTYNSYPLGWFRQAPGKEREFVAAISASGTLRAYADSVKGRFTISRDNAKNTVCLQMNNLKPEDTAVYYCAQHRSVGWRASHHLSDYDNWGQGTQVTVSS

SEQ ID NO: 1375 - protein, 126 aa, Artificial
  Nanobody against CTLA4
EVQLVESGGQLVQAGGSLRLSCAATGRTYNSYSLGWFRQAPGKEHEFVAAISASGTLRAYADSVKGRFTISRDNAKNTVYLQMNNLKPEDTAVYYCARHHSVGWRASHHLSDYDNWGQGTQVTVSS

SEQ ID NO: 1376 - protein, 126 aa, Artificial
  Nanobody against CTLA4
EVQLVKSGGQLVQAGGSLRLSCAATGRTYNSYPLGWFRQAPGKEREFVAAISASGTLRAYADSVKGRFTISRDSAKNTVYLQMNNLKPEDTAVYYCARARSVGWRASHHLSDYDNWGQGTQVTVSS

SEQ ID NO: 1377 - protein, 126 aa, Artificial
  Nanobody against CTLA4
EVQLVESGGQLVQAGGSLRLSCTATGHTFNTYPLAWFRQAPWKEREFVAAISPSGTLRAYADSVKGRFTISRGNAKNTVYLQMNNLKPEDTAVYYCARDRSVGWRASHHLSDYGNWGQGTQVTVSS

SEQ ID NO: 1378 - protein, 126 aa, Artificial
  Nanobody against CTLA4
EVQLVESGGQLVQAGGSLRLSCAATGRTYNSYPLGWFRQAPGKEREFVAAISASGTLRAYADSVKGRFTISRDNAKNTVYLQMNNLKPEDTAVYYCARDRSVGWRASHHLSDFDTWGQGTQVTVSS

SEQ ID NO: 1379 - protein, 124 aa, Artificial
  Nanobody against CTLA4
EVQLVESGGGLVQAGGSLRLSCAASGRTFSNTLMGWSRRAPGKEREFVAAISGSGTLTSYADSVKGRFAISRDNANDTVYLQMNSLKPEDTAIYYCAAGLTGWAVIPSRTLTTWGQGTQVTVSS

SEQ ID NO: 1380 - protein, 124 aa, Artificial
  Nanobody against CTLA4
EVQLVESGGGLVQAGGSLRLSCAASGRTFSNTLMGWSRRAPGKEREFVAAISGSGTLTSYADSVKGRFAISRBNANDTVYLQMNSLKPEDTAIYYCAAGLTGWAVIPSRTLTTWGQGTQVTVSS

SEQ ID NO: 1381 - protein, 124 aa, Artificial
  Nanobody against CTLA4
EVQLVESGGGLVQAGGSLRLSCAASGRTNSTTLMGWSRRAPGKEREFVAAISGSGTLTSYADSVKGRFAISRDNAKNTVYLQMNSLKPEDTAIYYCAAGLTSWALIPSRTLTTWGQGTQVTVSS

SEQ ID NO: 1382 - protein, 124 aa, Artificial
  Nanobody against CTLA4
EVQLVESGGGLVQAGGSLRLSCAAPGRTNSTTLMGWSRRAPGKEREFVAAISGSGTLTSYADSVKGRFAISRDNAKNTVYLQMNSLKPEDTAIYYCAAGLTSWALIPSRTLTTWGQGTQVTVSS

SEQ ID NO: 1383 - protein, 124 aa, Artificial
  Nanobody against CTLA4
EVQLVESGGGLVQPGGSLRLSCAASGRTNSTTLMGWSRRAPGKEREFVAAISGSGTLTSYADSVKGRFAISRDNAKNTVYLQMNSLKPEDTAIYYCAAGLTSWALIPSRTLTTWGQGTQVTVSS

SEQ ID NO: 1384 - protein, 128 aa, Artificial
  Nanobody against CTLA4
EVQLVESGGGLVQAGGSLRLSCAASGRMFSSRSIGWFRQVPGKEREFVAAISPSRSLKAYADSVKGRFTISGDNAKNTVDLQMNSLNVEDMAVYYCAADVISGRWYGGAFTPSRFDYWGQGTQVTVSS

SEQ ID NO: 1385 - protein, 128 aa, Artificial
  Nanobody against CTLA4
EVQLVESGGGLVQAGGSLALSCAASGRMFSSRSIGWFRQAPGKDREFVAAISPSGSLKAYADSVKGRFTISRDNAKNTVDLQMNSLNTEDMAVYYCAADVISGRWYAGAFTPSRFDYWGQGTQVTVSS

SEQ ID NO: 1386 - protein, 124 aa, Artificial; identical to SEQ ID NO: 1295
  Nanobody against CTLA4

SEQ ID NO: 1387 - protein, 126 aa, Artificial
  Nanobody against CTLA4
EVQLVESEGGLVQPGGSLRLSCSASGRTFANNAMGWFRQAPGKEREFVASISASGTLTSSADSVKGRFTISRDNAKNTVYLQMNSLKPEDTALYYCARNRRAWSLSVHTTREYDDWGQGTQVTVSS

SEQ ID NO: 1388 - protein, 126 aa, Artificial
  Nanobody against CTLA4
KVQLVESGGGLVQAGGSLRLSCSASGRTFANNAMGWFRQAPGKEREFVASLSASGSLTSYADSVNGRFTISRDNAKNTVYLQMNSLKPVDTALYYCARNRRAWSLSVHTTREYDDWGQGTQVTVSS

SEQ ID NO: 1389 - protein, 126 aa, Artificial
  Nanobody against CTLA4
EVQLVESGGGLVKAGDSLRLSCSASGRTFANNAMGWFRQAPGKEREFVASISASGTLTSSADSVRGRFTISRDNAKNTVYLQMNSLKPEDTALYYCARNRRAWSLSVHTTREYDDWGQGTQVTVSS

SEQ ID NO: 1390 - protein, 125 aa, Artificial
  Nanobody against CTLA4
EVQLVESGGGLVQAGGSLRLSCVASAEGSFSTYVMAWFRQAPGKEREFAAAISGRSGLTSYADSVKGRFTISRDNAKNTVYLQMNSLKPEDAARYYCAADRRAWSARPDMGNYYWGQGTQVTVSS

SEQ ID NO: 1391 - protein, 126 aa, Artificial
  Nanobody against CTLA4
EVQLVESGGGLVQAGGSLRLSCAASGRTFSNYTIAYFRQAPGREREFAAAISPHGTLRSFADSVKDRFTISRDNAKNTVWLQMNSLKLEDTAVYYCAADPSGWGLRQHSENEYPYWGLGTQVTVSS

SEQ ID NO: 1392 - protein, 371 aa, Artificial
  Multivalent Nanobody construct against CTLA4
EVQLVESGGGLVQAGGSLRLSCAASGGTFSFYGMGWFRQAPGKEQEFVADIRTSAGRTYYADSVKGRFTISRDNAKNTVYLQMNSLKPEDTAVYYCAAEMSGISGWDYWGQGTQVTVSSGGGGSGGGSEVQLVESGGGLVQAGGSLRLSCAASGGTFSFYGMGWFRQAPGKEQEFVADIRTSAGRTYYADSVKGRFTISRDNAKNTVYLQMNSLKPEDTAVYYCAAEMSGISGWDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 1393 - protein, 363 aa, Artificial
  Multivalent Nanobody construct against CTLA4
EVQLVESGGGLVEPGGSLRLSCAASGSISSYNVMGWYRQAPGQQRDLVAHIASNGEIMYADSAKGRFTISRDNAKKTVYLQMNSLKPEDTAVYYCKLWVLGNDYWGQETQVTVSSGGGGSGGGSEVQLVESGGGLVEPGGSLRLSCAASGSISSYNVMGWYRQAPGQQRDLVAHIASNGEIMYADSAKGRFTISRDNAKKTVYLQMNSLKPEDTAVYYCKLWVLGNDYWGQETQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 1394 - protein, 383 aa, Artificial
  Multivalent Nanobody construct against CTLA4
EVQLVESGGGLVQTGGSLRLSCAASGRTFSNYTMGWFRQAPGKDREFVAAISRSGALKAYADSVKGRFTPSRDNAKKMAYLQMNSLKPEDTAVYYCAAAPVPWGTRPSFFPYDSWGQGTQVTVSSGGGGSGGGSEVQLVESGGGLVQTGGSLRLSCAASGRTFSNYTMGWFRQAPGKDREFVAAISRSGALKAYADSVKGRFTPSRDNAKKMAYLQMNSLKPEDTAVYYCAAAPVPWGTRPSFFPYDSWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 1395 - protein, 385 aa, Artificial
  Multivalent Nanobody construct against CTLA4
EVQLVKSGGQLVQAGGSLRLSCAATGRTYNSYPLGWFRQAPGKEREFVAAISASGTLRAYADSVKGRFTISRDSAKNTVYLQMNNLKPEDTAVYYCARARSVGWRASHHLSDYDNWGQGTQVTVSSGGGGSGGGSEVQLVKSGGQLVQAGGSLRLSCAATGRTYNSYPLGWFRQAPGKEREFVAAISASGTLRAYADSVKGRFTISRDSAKNTVYLQMNNLKPEDTAVYYCARARSVGWRASHHLSDYDNWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 1396 - protein, 251 aa, Artificial
  Multivalent Nanobody construct against CTLA4
EVQLVESGGGLVQAGGSLRLSCAASGGTFSFYGMGWFRQAPGKEQEFVADIRTSAGRTYYADSVKGRFTISRDNAKNTVYLQMNSLKPEDTAVYYCAAEMSGISGWDYWGQGTQVTVSSGGGGSGGGSEVQLVESGGGLVQAGGSLRLSCAASGGTFSFYGMGWFRQAPGKEQEFVADIRTSAGRTYYADSVKGRFTISRDNAKNTVYLQMNSLKPEDTAVYYCAAEMSGISGWDYWGQGTQVTVSSGGGC

SEQ ID NO: 1397 - protein, 243 aa, Artificial
  Multivalent Nanobody construct against CTLA4
EVQLVESGGGLVEPGGSLRLSCAASGSISSYNVMGWYRQAPGQQRDLVAHIASNGEIMYADSAKGRFTISRDNAKKTVYLQMNSLKPEDTAVYYCKLWVLGNDYWGQETQVTVSSGGGGSGGGSEVQLVESGGGLVEPGGSLRLSCAASGSISSYNVMGWYRQAPGQQRDLVAHIASNGEIMYADSAKGRFTISRDNAKKTVYLQMNSLKPEDTAVYYCKLWVLGNDYWGQETQVTVSSGGGC

SEQ ID NO: 1398 - protein, 832 aa, Artificial [sequence omitted]

SEQ ID NO: 1399 - protein, 824 aa, Artificial
  Multivalent Nanobody construct against CTLA4
EVQLVESGGGLVEPGGSLRLSCAASGSISSYNVMGWYRQAPGQQRDLVAHIASNGEIMYADSAKGRFTISRDNAKKTVYLQMNSLKPEDTAVYYCKLWVLGNDYWGQETQVTVSSGGGGSGGGSEVQLVESGGGLVEPGGSLRLSCAASGSISSYNVMGWYRQAPGQQRDLVAHIASNGEIMYADSAKGRFTISRDNAKKTVYLQMNSLKPEDTAVYYCKLWVLGNDYWGQETQVTVSSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 1400 - protein, 98 aa, Artificial
  Artificial sequence
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAK

SEQ ID NO: 1401 - protein, 98 aa, Artificial
  Artificial sequence
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCAR

SEQ ID NO: 1402 - protein, 98 aa, Artificial
  Artificial sequence
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAR

SEQ ID NO: 1403 - protein, 97 aa, Artificial
  Artificial sequence
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCAR

SEQ ID NO: 1404 - protein, 97 aa, Artificial
  Artificial sequence
EVQLVESGGGLIQPGGSLRLSCAASGFTVSSNYMSWVRQAPGKGLEWVSVIYSCGSTYYADSVKGRFTISRDNSKNTLYLQMNSLRAEDTAVYYCAR

SEQ ID NO: 1405 - protein, 98 aa, Artificial
  Artificial sequence
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCAR

SEQ ID NO: 1406 - protein, 11 aa, Artificial
  Artificial sequence
WGQGTLVTVSS

SEQ ID NO: 1407 - protein, 119 aa, Artificial
  Humanized Nanobody against CTLA4
EVQLVESGGGLVQPGGSLRLSCAASGGTFSFYGMGWFRQAPGKGQEFVADIRTSAGRTYYADSVKGRFTISRDNAKNTLYLQMNSLRPEDTAVYYCAAEMSGISGWDYWGQGTLVTVSS

SEQ ID NO: 1408 - protein, 119 aa, Artificial
  Humanized Nanobody against CTLA4
EVQLVESGGGLVQPGGSLRLSCAASGFTFSFYGMGWFRQAPGKGQEFVADIRTSAGRTYYADSVKGRFTISRDNAKNTLYLQMNSLRPEDTAVYYCAAEMSGISGWDYWGQGTLVTVSS

SEQ ID NO: 1409 - protein, 119 aa, Artificial
  Humanized Nanobody against CTLA4
EVQLVESGGGLVQPGGSLRLSCAASGGTFSFYGMGWFRQAPGKGQEFVADIRTSAGRTYYADSVKGRFTISRDNSKNTLYLQMNSLRPEDTAVYYCAAEMSGISGWDYWGQGTLVTVSS

SEQ ID NO: 1410 - protein, 119 aa, Artificial
  Humanized Nanobody against CTLA4
EVQLVESGGGLVQPGGSLRLSCAASGGTFSFYGMGWFRQAPGKGQEFVADIRTSAGRTYYADSVKGRFTISRDNAKNSLYLQMNSLRPEDTAVYYCAAEMSGISGWDYWGQGTLVTVSS

SEQ ID NO: 1411 - protein, 119 aa, Artificial
  Humanized Nanobody against CTLA4
EVQLVESGGGLVQPGGSLRLSCAASGGTFSFYGMGWFRQAPGKGQEFVSDIRTSAGRTYYADSVKGRFTISRDNAKNTLYLQMNSLRPEDTAVYYCAAEMSGISGWDYWGQGTLVTVSS

SEQ ID NO: 1412 - protein, 119 aa, Artificial
  Humanized Nanobody against CTLA4
EVQLVESGGGLVQPGGSLRLSCAASGGTFSFYGMGWFRQAPGKGQEFVADIRTSAGRTYYAESVKGRFTISRDNAKNTLYLQMNSLRPEDTAVYYCAAEMSGISGWDYWGQGTLVTVSS

SEQ ID NO: 1413 - protein, 115 aa, Artificial
  Humanized Nanobody against CTLA4
EVQLVESGGGLIQPGGSLRLSCAASGSISSYNVMGWYRQAPGQGRDLVAHIASNGEIMYADSAKGRFTISRDNAKKTLYLQMNSLRPEDTAVYYCKLWVLGNDYWGQGTLVTVSS

SEQ ID NO: 1414 - protein, 115 aa, Artificial
  Humanized Nanobody against CTLA4
EVQLVESGGGLIQPGGSLRLSCAASGFTVSYNVMGWYRQAPGQGRDLVAHIASNGEIMYADSAKGRFTISRDNAKKTLYLQMNSLRPEDTAVYYCKLWVLGNDYWGQGTLVTVSS

SEQ ID NO: 1415 - protein, 115 aa, Artificial
  Humanized Nanobody against CTLA4
EVQLVESGGGLIQPGGSLRLSCAASGSISSYNVMGWYRQAPGKGRDLVAHIASNGEIMYADSAKGRFTISRDNAKKTLYLQMNSLRPEDTAVYYCKLWVLGNDYWGQGTLVTVSS

SEQ ID NO: 1416 - protein, 115 aa, Artificial
  Humanized Nanobody against CTLA4
EVQLVESGGGLIQPGGSLRLSCAASGSISSYNVMGWYRQAPGQGRELVAHIASNGEIMYADSAKGRFTISRDNAKKTLYLQMNSLRPEDTAVYYCKLWVLGNDYWGQGTLVTVSS

SEQ ID NO: 1417 - protein, 115 aa, Artificial
  Humanized Nanobody against CTLA4
EVQLVESGGGLIQPGGSLRLSCAASGSISSYNVMGWYRQAPGQGRDLVSHIASNGEIMYADSAKGRFTISRDNAKKTLYLQMNSLRPEDTAVYYCKLWVLGNDYWGQGTLVTVSS

SEQ ID NO: 1418 - protein, 115 aa, Artificial
  Humanized Nanobody against CTLA4
EVQLVESGGGLIQPGGSLRLSCAASGSISSYNVMGWYRQAPGQGRDLVAHIASNGEIMYADSAKGRFTISRDNAKNTLYLQMNSLRPEDTAVYYCKLWVLGNDYWGQGTLVTVSS

The invention claimed is:

1. A polypeptide that binds CD28 and reduces, inhibits, prevents and/or blocks the interaction between CD80-Fc or CD86-Fc and cell-displayed CD28, and that comprises three stretches of amino acid residues chosen from:
SEQ ID NOs: 518, 530, and 542;
SEQ ID NOs: 519, 531, and 543;
SEQ ID NOs: 520, 532, and 544;
SEQ ID NOs: 521, 533, and 545;
SEQ ID NOs: 522, 534, and 546; and
SEQ ID NOs: 523, 535, and 547.

2. A polypeptide according to claim 1, that can specifically bind CD28 with a dissociation constant ($K_D$) of $10^{-5}$ to $10^{-12}$ moles/liter or less, $10^{-7}$ to $10^{-12}$ moles/liter or less or $10^{-8}$ to $10^{-12}$ moles/liter.

3. A polypeptide according to claim 1, that can specifically bind CD28 with a rate of association ($k_{on}$-rate) of between $10^2$ $M^{-1}s^{-1}$ to about $10^7$ $M^{-1}s^{-1}$, between $10^3$ $M^{-1}s^{-1}$ and $10^7$ $M^{-1}s^{-1}$, between $10^4$ $M^{-1}s^{-1}$ and $10^7$ $M^{-1}s^{-1}$, or between $10^5$ $M^{-1}s^{-1}$ and $10^7$ $M^{-1}s^{-1}$.

4. A polypeptide according to claim 1, that can specifically bind CD28 with a rate of dissociation ($k_{off}$-rate) between $1\ s^{-1}$ and $10^{-6}\ s^{-1}$, between $10^{-2}\ s^{-1}$ and $10^{-6}\ s^{-1}$, between $10^{-3}\ s^{-1}$ and $10^{-6}\ s^{-1}$, or between $10^{-4}\ s^{-1}$ and $10^{-6}\ s^{-1}$.

5. A polypeptide according to claim 1, that can specifically bind CD28 with an affinity less than 500 nM, less than 200 nM, less than 10 nM, or less than 500 pM.

6. A polypeptide according to claim 1, that comprises an immunoglobulin fold or that under suitable conditions is capable of forming an immunoglobulin fold.

7. A polypeptide according to claim 1, that essentially consists of a light chain variable domain sequence or of a heavy chain variable domain sequence.

8. A polypeptide according to claim 1, that essentially consists of a domain antibody, a single domain antibody, a $V_{HH}$, a humanized $V_{HH}$, or a camelized $V_H$.

9. A polypeptide according to claim 1, that essentially consists of a $V_{HH}$, a humanized $V_{HH}$, or a camelized $V_H$ that
has at least 80% amino acid identity with at least one of the amino acid sequences of SEQ ID NO's: 1 to 22, in which for the purposes of determining the degree of amino acid identity, the amino acid residues that form the CDR sequences are disregarded;
and in which:
one or more of the amino acid residues at positions 11, 37, 44, 45, 47, 83, 84, 103, 104 and 108 according to the Kabat numbering are chosen from
at position 11: L, M, S, V, W,
at position 37: F, Y, H, I, L, V,
at position 44: G, E, A, D, Q, R, S, L,
at position 45: L, R, C, I, L, P, Q, V,
at position 47: W, L, F, A, G, I, M, R, S, V, Y,
at position 83: R, K, N, E, G, I, M, Q, T,
at position 84: P, A, L, R, S, T, D, V,
at position 103: W, P, R, S,
at position 104: G, D, and
at position 108: Q, L, R.

10. A polypeptide according to claim 1, that essentially consists of a $V_{HH}$, a humanized $V_{HH}$, or a camelized $V_H$ that
i) has at least 80% amino acid identity with at least one of the amino acid sequences of SEQ ID NO's: 266-285, 347-351, 394-399, 449-455, 505-511, 554-559 or 1288-1391 in which for the purposes of determining the degree of amino acid identity, the amino acid residues that form the CDR sequences are disregarded;
and in which:
one or more of the amino acid residues at positions 11, 37, 44, 45, 47, 83, 84, 103, 104 and 108 according to the Kabat numbering are chosen from
at position 11: L, M, S, V, W,
at position 37: F, Y, H, I, L, V,
at position 44: G, E, A, D, Q, R, S, L,
at position 45: L, R, C, I, L, P, Q, V,
at position 47: W, L, F, A, G, I, M, R, S, V, Y,
at position 83: R, K, N, E, G, I, M, Q, T,
at position 84: P, A, L, R, S, T, D, V,
at position 103: W, P, R, S,
at position 104: G, D, and
at position 108: Q, L, R.

11. A polypeptide according to claim 1, that essentially consists of a humanized $V_{HH}$.

12. A polypeptide that cross-blocks the binding to CD28 by at least one of the polypeptides according to claim 1.

13. A polypeptide that is cross-blocked from binding to CD28 by at least one of the polypeptides according to claim 1.

14. A compound or a construct, that comprises or essentially consists of one or more polypeptides according to claim 1, and optionally further comprises one or more other groups, residues, moieties or binding units, optionally linked via one or more linkers.

15. A compound or a construct according to claim 14, in which said one or more other groups, residues, moieties or binding units are chosen from the group consisting of domain antibodies, single domain antibodies, $V_{HH}$s, humanized $V_{HH}$s or camelized $V_H$s.

16. A compound or a construct according to claim 14, in which said one or more polypeptides are chosen from the group consisting of domain antibodies, single domain antibodies, $V_{HH}$s, humanized $V_{HH}$s or camelized $V_H$s.

17. A compound or a construct according to claim 14, which is a multivalent construct.

18. A compound or a construct according to claim 14, which is a multispecific construct.

19. A compound or a construct according to claim 14, in which said one or more other groups, residues, moieties or binding units provide the compound or construct with increased serum half-life, compared to the polypeptide without the one or more other groups, residues, moieties or binding units.

20. A compound or a construct according to claim 19, in which said one or more other groups, residues, moieties or binding units that provide the compound or construct with increased serum half-life is chosen from the group consisting of serum proteins or fragments thereof, binding units that can bind to serum proteins, an Fc portion, and small proteins or peptides that can bind to serum proteins.

21. A compound or a construct according to claim 19, in which said one or more other groups, residues, moieties or binding units that provide the compound or construct with increased serum half-life are selected from the group consisting of human serum albumin and fragments thereof.

22. A compound or a construct according to claim 20, in which said one or more other groups, residues, moieties or binding units that provides the compound or construct with increased serum half-life are selected from the group consisting of binding units that can bind to serum albumin, human serum albumin, and a serum immunoglobulin.

23. A compound or a construct according to claim 19, in which said one or more other groups, residues, moieties or binding units that provides the compound or construct with increased serum half-life are selected from the group consisting of domain antibodies, single domain antibodies, $V_{HH}$s, humanized $V_{HH}$s and camelized $V_H$s that can bind to serum albumin, human serum albumin, or a serum immunoglobulin.

24. A compound or a construct according to claim 19, in which said one or more other groups, residues, moieties or binding units that provides the compound or construct with increased serum half-life is a $V_{HH}$, a humanized $V_{HH}$ or a camelized $V_H$ that can bind to serum albumin, human serum albumin, or a serum immunoglobulin.

25. A compound or a construct according to claim 19, that has a serum half-life that is at least 1.5 times, at least 2 times, at least 5 times, at least 10 times or more than 20 times, greater than the half-life of the polypeptide without the one or more other groups, residues, moieties or binding units.

26. A compound or a construct according to claim 19, that has a serum half-life that is increased with more than 1 hours, more than 2 hours, more than 6 hours, more than 12 hours, or more than 24, 48 or 72 hours, compared to the polypeptide without the one or more other groups, residues, moieties or binding units.

27. A compound or a construct according to claim 19, that has a serum half-life in human of at least about 12 hours, at least 24 hours, at least 48 hours, at least 72 hours; of at least 5 days, at least 9 days, 9 to 14 days, at least about 10 days, about 10 to 15 days, at least about 11 days, about 11 to 16 days, at least about 12 days, about 12 to 18 days, more than 14 days, or about 14 to 19 days.

28. A monovalent construct, comprising or essentially consisting of one polypeptide according to claim 1.

29. A composition, comprising at least one polypeptide according to claim 1.

30. A composition according to claim 29, which is a pharmaceutical composition, that further comprises at least one pharmaceutically acceptable carrier, diluent or excipient and/or adjuvant, and that optionally comprises one or more further pharmaceutically active polypeptides and/or compounds.

31. A polypeptide according to claim 1, that is pegylated.

32. A polypeptide that binds CD28 and reduces, inhibits, prevents and/or blocks the interaction between CD80-Fc or CD86-Fc and cell-displayed CD28, and that essentially consists of 4 framework regions (FR1 to FR4, respectively) and 3 complementarity determining regions (CDR1 to CDR3, respectively), in which:

CDR1 is SEQ ID NO: 518, CDR2 is SEQ ID NO: 530, and CDR3 is SEQ ID NO: 542;

CDR1 is SEQ ID NO: 519, CDR2 is SEQ ID NO: 531, and CDR3 is SEQ ID NO: 543;

CDR1 is SEQ ID NO: 520, CDR2 is SEQ ID NO: 532, and CDR3 is SEQ ID NO: 544;

CDR1 is SEQ ID NO: 521, CDR2 is SEQ ID NO: 533, and CDR3 is SEQ ID NO: 545;

CDR1 is SEQ ID NO: 522, CDR2 is SEQ ID NO: 534, and CDR3 is SEQ ID NO: 546; or

CDR1 is SEQ ID NO: 523, CDR2 is SEQ ID NO: 535, and CDR3 is SEQ ID NO: 547.

33. A polypeptide that cross-blocks the binding to CD28 by at least one of the polypeptides according to claim 32.

34. A polypeptide that is cross-blocked from binding to CD28 by at least one of the polypeptides according to claim 32.

* * * * *